(12) United States Patent
Tang et al.

(10) Patent No.: US 6,569,662 B1
(45) Date of Patent: May 27, 2003

(54) NUCLEIC ACIDS AND POLYPEPTIDES

(75) Inventors: Y. Tom Tang, San Jose, CA (US); Ping Zhou, San Jose, CA (US); Radoje T. Drmanac, Palo Alto, CA (US)

(73) Assignee: Hyseq, Inc., Sunnyvale, CA (US)

( * ) Notice: Subject to any disclaimer, the term of this patent is extended or adjusted under 35 U.S.C. 154(b) by 0 days.

(21) Appl. No.: 09/620,312

(22) Filed: Jul. 19, 2000

Related U.S. Application Data

(63) Continuation-in-part of application No. 09/552,317, filed on Apr. 25, 2000, now abandoned, which is a continuation-in-part of application No. 09/488,725, filed on Jan. 21, 2000.

(51) Int. Cl.⁷ .............................. C12N 9/00; C12N 9/14; C12N 9/48; C12N 9/76; C12N 9/74; C12N 9/64; C12N 9/28

(52) U.S. Cl. .................. 435/212; 435/183; 435/195; 435/213; 435/214; 435/218; 435/219; 435/226; 435/227

(58) Field of Search .............................. 435/69.1, 252.3, 435/320.1, 183, 212, 219, 226, 213, 214, 218, 227; 536/23.2

(56) References Cited

PUBLICATIONS

Hattori et al. J. Biochem., vol. 125:931–938, 1999.*
Nagase T et al. DNA Res. vol. 5:31–39, 1998.*
GenBank Accession No. AB011097, Ohara et al., Apr. 10, 1998.*
GenBank Accession No. AF183569, Schomburg et al., Dec. 29, 1999.*
GenBank Accession No. AF106037 Hattori et al., Nov. 17, 1999.*

* cited by examiner

*Primary Examiner*—Rebecca E. Prouty
*Assistant Examiner*—Manjunath N. Rao

(57) ABSTRACT

The present invention provides novel nucleic acids, novel polypeptide sequences encoded by these nucleic acids and uses thereof.

2 Claims, No Drawings

NUCLEIC ACIDS AND POLYPEPTIDES

1.1. CROSS REFERENCE TO RELATED APPLICATIONS

This application is a continuation-in-part application of U.S. application Ser. No. 09/552,317, filed Apr. 25, 2000 now abandoned, which in turn is a continuation-in-part application of U.S. application Ser. No. 09/488,725, filed Jan. 21, 2000, both of which are incorporated herein by reference in their entirety.

1.2. SEQUENCE LISTING

The material included on the compact disk, created Feb. 7, 2001, and entitled "PT_FL.784CIP2B.071000.UPDATE" which is a 7.78 MB file that comprises the sequence listing, is hereby incorporated by reference into the application in its entirety.

2. BACKGROUND OF THE INVENTION

2.1 Technical Field

The present invention provides novel polynucleotides and proteins encoded by such polynucleotides, along with uses for these polynucleotides and proteins, for example in therapeutic, diagnostic and research methods.

2.2 Background

Technology aimed at the discovery of protein factors (including e.g., cytokines, such as lymphokines, interferons, CSFs, chemokines, and interleukins) has matured rapidly over the past decade. The now routine hybridization cloning and expression cloning techniques clone novel polynucleotides "directly" in the sense that they rely on information directly related to the discovered protein (i.e., partial DNA/amino acid sequence of the protein in the case of hybridization cloning; activity of the protein in the case of expression cloning). More recent "indirect" cloning techniques such as signal sequence cloning, which isolates DNA sequences based on the presence of a now well-recognized secretory leader sequence motif, as well as various PCR-based or low stringency hybridization-based cloning techniques, have advanced the state of the art by making available large numbers of DNA/amino acid sequences for proteins that are known to have biological activity, for example, by virtue of their secreted nature in the case of leader sequence cloning, by virtue of their cell or tissue source in the case of PCR-based techniques, or by virtue of structural similarity to other genes of known biological activity.

Identified polynucleotide and polypeptide sequences have numerous applications in, for example, diagnostics, forensics, gene mapping; identification of mutations responsible for genetic disorders or other traits, to assess biodiversity, and to produce many other types of data and products dependent on DNA and amino acid sequences.

3. SUMMARY OF THE INVENTION

The compositions of the present invention include novel isolated polypeptides, novel isolated polynucleotides encoding such polypeptides, including recombinant DNA molecules, cloned genes or degenerate variants thereof, especially naturally occurring variants such as allelic variants, antisense polynucleotide molecules, and antibodies that specifically recognize one or more epitopes present on such polypeptides, as well as hybridomas producing such antibodies.

The compositions of the present invention additionally include vectors, including expression vectors, containing the polynucleotides of the invention, cells genetically engineered to contain such polynucleotides and cells genetically engineered to express such polynucleotides.

The present invention relates to a collection or library of at least one novel nucleic acid sequence assembled from expressed sequence tags (ESTs) isolated mainly by sequencing by hybridization (SBH), and in some cases, sequences obtained from one or more public databases. The invention relates also to the proteins encoded by such polynucleotides, along with therapeutic, diagnostic and research utilities for these polynucleotides and proteins. These nucleic acid sequences are designated as SEQ ID NO: 1–1104 and are provided in the Sequence Listing. In the nucleic acids provided in the Sequence Listing, A is adenosine; C is cytosine; G is guanosine; T is thymine; and N is any of the four bases. In the amino acids provided in the Sequence Listing, * corresponds to the stop codon.

The nucleic acid sequences of the present invention also include, nucleic acid sequences that hybridize to the complement of SEQ ID NO: 1–1104 under stringent hybridization conditions; nucleic acid sequences which are allelic variants or species homologues of any of the nucleic acid sequences recited above, or nucleic acid sequences that encode a peptide comprising a specific domain or truncation of the peptides encoded by SEQ ID NO: 1–1104. A polynucleotide comprising a nucleotide sequence having at least 90% identity to an identifying sequence of SEQ ID NO: 1–1104 or a degenerate variant or fragment thereof. The identifying sequence can be 100 base pairs in length.

The nucleic acid sequences of the present invention also include the sequence information from the nucleic acid sequences of SEQ ID NO: 1–1104. The sequence information can be a segment of any one of SEQ ID NO: 1–1104 that uniquely identifies or represents the sequence information of SEQ ID NO: 1–1104.

A collection as used in this application can be a collection of only one polynucleotide. The collection of sequence information or identifing information of each sequence can be provided on a nucleic acid array. In one embodiment, segments of sequence information is provided on a nucleic acid array to detect the polynucleotide that contains the segment. The array can be designed to detect full-match or mismatch to the polynucleotide that contains the segment. The collection can also be provided in a computer-readable format.

This invention also includes the reverse or direct complement of any of the nucleic acid sequences recited above; cloning or expression vectors containing the nucleic acid sequences; and host cells or organisms transformed with these expression vectors. Nucleic acid sequences (or their reverse or direct complements) according to the invention have numerous applications in a variety of techniques known to those skilled in the art of molecular biology, such as use as hybridization probes, use as primers for PCR, use in an array, use in computer-readable media, use in sequencing full-length genes, use for chromosome and gene mapping, use in the recombinant production of protein, and use in the generation of anti-sense DNA or RNA, their chemical analogs and the like.

In a preferred embodiment, the nucleic acid sequences of SEQ ID NO: 1–1104 or novel segments or parts of the nucleic acids of the invention are used as primers in expression assays that are well known in the art. In a particularly preferred embodiment, the nucleic acid sequences of SEQ ID NO: 1–1104 or novel segments or parts of the nucleic acids provided herein are used in diagnostics for identifing expressed genes or, as well known in the art and exemplified by Vollrath et al., Science 258:52–59 (1992), as expressed sequence tags for physical mapping of the human genome.

The isolated polynucleotides of the invention include, but are not limited to, a polynucleotide comprising any one of the nucleotide sequences set forth in the SEQ ID NO: 1–1104; a polynucleotide comprising any of the full length protein coding sequences of the SEQ ID NO: 1–1104; and a polynucleotide comprising any of the nucleotide sequences of the mature protein coding sequences of the SEQ ID NO: 1–1104. The polynucleotides of the present invention also include, but are not limited to, a polynucleotide that hybridizes under stringent hybridization conditions to (a) the complement of any one of the nucleotide sequences set forth in the SEQ ID NO: 1–1104; (b) a nucleotide sequence encoding any one of the amino acid sequences set forth in the Sequence Listing; (c) a polynucleotide which is an allelic variant of any polynucleotides recited above; (d) a polynucleotide which encodes a species homolog (e.g. orthologs) of any of the proteins recited above; or (e) a polynucleotide that encodes a polypeptide comprising a specific domain or truncation of any of the polypeptides comprising an amino acid sequence set forth in the Sequence Listing.

The isolated polypeptides of the invention include, but are not limited to, a polypeptide comprising any of the amino acid sequences set forth in the Sequence Listing; or the corresponding full length or mature protein. Polypeptides of the invention also include polypeptides with biological activity that are encoded by (a) any of the polynucleotides having a nucleotide sequence set forth in the SEQ ID NO: 1–1104; or (b) polynucleotides that hybridize to the complement of the polynucleotides of (a) under stringent hybridization conditions. Biologically or immunologically active variants of any of the polypeptide sequences in the Sequence Listing, and "substantial equivalents" thereof (e.g., with at least about 65%, 70%, 75%, 80%, 85%, 90%, 95%, 98% or 99% amino acid sequence identity) that preferably retain biological activity are also contemplated. The polypeptides of the invention may be wholly or partially chemically synthesized but are preferably produced by recombinant means using the genetically engineered cells (e.g. host cells) of the invention.

The invention also provides compositions comprising a polypeptide of the invention. Polypeptide compositions of the invention may further comprise an acceptable carrier, such as a hydrophilic, e.g., pharmaceutically acceptable, carrier.

The invention also provides host cells transformed or transfected with a polynucleotide of the invention.

The invention also relates to methods for producing a polypeptide of the invention comprising growing a culture of the host cells of the invention in a suitable culture medium under conditions permitting expression of the desired polypeptide, and purifying the polypeptide from the culture or from the host cells. Preferred embodiments include those in which the protein produced by such process is a mature form of the protein.

Polynucleotides according to the invention have numerous applications in a variety of techniques known to those skilled in the art of molecular biology. These techniques include use as hybridization probes, use as oligomers, or primers, for PCR, use for chromosome and gene mapping, use in the recombinant production of protein, and use in generation of anti-sense DNA or RNA, their chemical analogs and the like. For example, when the expression of an mRNA is largely restricted to a particular cell or tissue type, polynucleotides of the invention can be used as hybridization probes to detect the presence of the particular cell or tissue niRNA in a sample using, e.g., in situ hybridization.

In other exemplary embodiments, the polynucleotides are used in diagnostics as expressed sequence tags for identifying expressed genes or, as well known in the art and exemplified by Vollrath et al., Science 258:52–59 (1992), as expressed sequence tags for physical mapping of the human genome.

The polypeptides according to the invention can be used in a variety of conventional procedures and methods that are currently applied to other proteins. For example, a polypeptide of the invention can be used to generate an antibody that specifically binds the polypeptide. Such antibodies, particularly monoclonal antibodies, are useful for detecting or quantitating the polypeptide in tissue. The polypeptides of the invention can also be used as molecular weight markers, and as a food supplement.

Methods are also provided for preventing, treating, or ameliorating a medical condition which comprises the step of administering to a mammalian subject a therapeutically effective amount of a composition comprising a polypeptide of the present invention and a pharmaceutically acceptable carrier.

In particular, the polypeptides and polynucleotides of the invention can be utilized, for example, in methods for the prevention and/or treatment of disorders involving aberrant protein expression or biological activity.

The present invention further relates to methods for detecting the presence of the polynucleotides or polypeptides of the invention in a sample. Such methods can, for example, be utilized as part of prognostic and diagnostic evaluation of disorders as recited herein and for the identification of subjects exhibiting a predisposition to such conditions. The invention provides a method for detecting the polynucleotides of the invention in a sample, comprising contacting the sample with a compound that binds to and forms a complex with the polynucleotide of interest for a period sufficient to form the complex and under conditions sufficient to form a complex and detecting the complex such that if a complex is detected, the polynucleotide of interest is detected. The invention also provides a method for detecting the polypeptides of the invention in a sample comprising contacting the sample with a compound that binds to and forms a complex with the polypeptide under conditions and for a period sufficient to form the complex and detecting the formation of the complex such that if a complex is formed, the polypeptide is detected.

The invention also provides kits comprising polynucleotide probes and/or monoclonal antibodies, and optionally quantitative standards, for carrying out methods of the invention. Furthermore, the invention provides methods for evaluating the efficacy of drugs, and monitoring the progress of patients, involved in clinical trials for the treatment of disorders as recited above.

The invention also provides methods for the identification of compounds that modulate (i.e., increase or decrease) the expression or activity of the polynucleotides and/or polypeptides of the invention. Such methods can be utilized, for example, for the identification of compounds that can ameliorate symptoms of disorders as recited herein. Such methods can include, but are not limited to, assays for identifying compounds and other substances that interact with (e.g., bind to) the polypeptides of the invention. The invention provides a method for identifying a compound that binds to the polypeptides of the invention comprising contacting the compound with a polypeptide of the invention in a cell for a time sufficient to form a polypeptide/compound complex, wherein the complex drives expression of a reporter gene sequence in the cell; and detecting the complex by detecting the reporter gene sequence expression such that if expression of the reporter gene is detected the compound the binds to a polypeptide of the invention is identified.

The methods of the invention also provides methods for treatment which involve the administration of the polynucleotides or polypeptides of the invention to individuals exhibiting symptoms or tendencies. In addition, the invention encompasses methods for treating diseases or disorders as recited herein comprising administering compounds and other substances that modulate the overall activity of the target gene products. Compounds and other substances can effect such modulation either on the level of target gene/protein expression or target protein activity.

The polypeptides of the present invention and the polynucleotides encoding them are also useful for the same functions known to one of skill in the art as the polypeptides and polynucleotides to which they have the closest homology (set forth in Table 1). If no homology is set forth for a sequence, then the polypeptides and polynucleotides of the present invention are useful for a variety of applications, as described herein, including use in arrays for detection.

4. DETAILED DESCRIPTION OF THE INVENTION

4.1 DEFINITIONS

It must be noted that as used herein and in the appended claims, the singular forms "a", "an" and "the" include plural references unless the context clearly dictates otherwise.

The term "active" refers to those forms of the polypeptide which retain the biologic and/or immunologic activities of any naturally occurring polypeptide. According to the invention, the terms "biologically active" or "biological activity" refer to a protein or peptide having structural, regulatory or biochemical functions of a naturally occurring molecule. Likewise "immunologically active" or "immunological activity" refers to the capability of the natural, recombinant or synthetic polypeptide to induce a specific immune response in appropriate animals or cells and to bind with specific antibodies.

The term "activated cells" as used in this application are those cells which are engaged in extracellular or intracellular membrane trafficking, including the export of secretory or enzymatic molecules as part of a normal or disease process.

The terms "complementary" or "complementarity" refer to the natural binding of polynucleotides by base pairing. For example, the sequence 5'-AGT-3' binds to the complementary sequence 3'-TCA-5'. Complementarity between two single-stranded molecules may be "partial" such that only some of the nucleic acids bind or it may be "complete" such that total complementarity exists between the single stranded molecules. The degree of complementarity between the nucleic acid strands has significant effects on the efficiency and strength of the hybridization between the nucleic acid strands.

The term "embryonic stem cells (ES)" refers to a cell that can give rise to many differentiated cell types in an embryo or an adult, including the germ cells. The term "germ line stem cells (GSCs)" refers to stem cells derived from primordial stem cells that provide a steady and continuous source of germ cells for the production of gametes. The term "primordial germ cells (PGCs)" refers to a small population of cells set aside from other cell lineages particularly from the yolk sac, mesenteries, or gonadal ridges during embryogenesis that have the potential to differentiate into germ cells and other cells. PGCs are the source from which GSCs and ES cells are derived The PGCs, the GSCs and the ES cells are capable of self-renewal. Thus these cells not only populate the germ line and give rise to a plurality of terminally differentiated cells that comprise the adult specialized organs, but are able to regenerate themselves.

The term "expression modulating fragment," EMF, means a series of nucleotides which modulates the expression of an operably linked ORF or another EMF.

As used herein, a sequence is said to "modulate the expression of an operably linked sequence" when the expression of the sequence is altered by the presence of the EMF. EMFs include, but are not limited to, promoters, and promoter modulating sequences (inducible elements). One class of EMFs are nucleic acid fragments which induce the expression of an operably linked ORF in response to a specific regulatory factor or physiological event.

The terms "nucleotide sequence" or "nucleic acid" or "polynucleotide" or "oligonculeotide" are used interchangeably and refer to a heteropolymer of nucleotides or the sequence of these nucleotides. These phrases also refer to DNA or RNA of genomic or synthetic origin which may be single-stranded or double-stranded and may represent the sense or the antisense strand, to peptide nucleic acid (PNA) or to any DNA-like or RNA-like material. Generally, nucleic acid segments provided by this invention may be assembled from fragments of the genome and short oligonucleotide linkers, or from a series of oligonucleotides, or from individual nucleotides, to provide a synthetic nucleic acid which is capable of being expressed in a recombinant transcriptional unit comprising regulatory elements derived from a microbial or viral operon, or a eukaryotic gene.

The terms "oligonucleotide fragment" or a "polynucleotide fragment", "portion," or "segment" or "probe" or "primer" are used interchangeable and refer to a sequence of nucleotide residues which are at least about 5 nucleotides, more preferably at least about 7 nucleotides, more preferably at least about 9 nucleotides, more preferably at least about 11 nucleotides and most preferably at least about 17 nucleotides. The fragment is preferably less than about 500 nucleotides, preferably less than about 200 nucleotides, more preferably less than about 100 nucleotides, more preferably less than about 50 nucleotides and most preferably less than 30 nucleotides. Preferably the probe is from about 6 nucleotides to about 200 nucleotides, preferably from about 15 to about 50 nucleotides, more preferably from about 17 to 30 nucleotides and most preferably from about 20 to 25 nucleotides. Preferably the fragments can be used in polymerase chain reaction (PCR), various hybridization procedures or microarray procedures to identify or amplify identical or related parts of mRNA or DNA molecules. A fragment or segment may uniquely identify each polynucleotide sequence of the present invention. Preferably the fragment comprises a sequence substantially similar to any one of SEQ ID NOs: 1–1104.

Probes may, for example, be used to determine whether specific mRNA molecules are present in a cell or tissue or to isolate similar nucleic acid sequences from chromosomal DNA as described by Walsh et al. (Walsh, P. S. et al., 1992, PCR Methods Appl 1:241–250). They may be labeled by nick translation, Klenow fill-in reaction, PCR, or other methods well known in the art. Probes of the present invention, their preparation and/or labeling are elaborated in Sambrook, J. et al., 1989, Molecular Cloning: A Laboratory Manual, Cold Spring Harbor Laboratory, NY; or Ausubel, F. M. et al., 1989, Current Protocols in Molecular Biology, John Wiley & Sons, New York N.Y., both of which are incorporated herein by reference in their entirety.

The nucleic acid sequences of the present invention also include the sequence information from the nucleic acid sequences of SEQ ID NOs: 1–1104. The sequence information can be a segment of any one of SEQ ID NOs: 1–1104 that uniquely identifies or represents the sequence information of that sequence of SEQ ID NO: 1–1104. One such segment can be a twenty-mer nucleic acid sequence because the probability that a twenty-mer is fully matched in the human genome is 1 in 300. In the human genome, there are three billion base pairs in one set of chromosomes. Because $4^{20}$ possible twenty-mers exist, there are 300 times more twenty-mers than there are base pairs in a set of human chromosome. Using the same analysis, the probability for a seventeen-mer to be fully matched in the human genome is approximately 1 in 5. When these segments are used in arrays for expression studies, fifteen-mer segments can be used. The probability that the fifteen-mer is fully matched in the expressed sequences is also approximately one in five because expressed sequences comprise less than approximately 5% of the entire genome sequence.

Similarly, when using sequence information for detecting a single mismatch, a segment can be a twenty-five mer. The probability that the twenty-five mer would appear in a human genome with a single mismatch is calculated by multiplying the probability for a full match ($1 \div 4^{25}$) times the increased probability for mismatch at each nucleotide position ($3 \times 25$). The probability that an eighteen mer with a single mismatch can be detected in an array for expression studies is approximately one in five. The probability that a twenty-mer with a single mismatch can be detected in a human genome is approximately one in five.

The term "open reading frame," ORF, means a series of nucleotide triplets coding for amino acids without any termination codons and is a sequence translatable into protein.

The terms "operably linked" or "operably associated" refer to functionally related nucleic acid sequences. For example, a promoter is operably associated or operably linked with a coding sequence if the promoter controls the transcription of the coding sequence. While operably linked nucleic acid sequences can be contiguous and in the same reading frame, certain genetic elements e.g. repressor genes are not contiguously linked to the coding sequence but still control transcription/translation of the coding sequence.

The term "pluripotent" refers to the capability of a cell to differentiate into a number of differentiated cell types that are present in an adult organism. A pluripotent cell is restricted in its differentiation capability in comparison to a totipotent cell.

The terms "polypeptide" or "peptide" or "amino acid sequence" refer to an oligopeptide, peptide, polypeptide or protein sequence or fragment thereof and to naturally occurring or synthetic molecules. A polypeptide "fragment," "portion," or "segment" is a stretch of amino acid residues of at least about 5 amino acids, preferably at least about 7 amino acids, more preferably at least about 9 amino acids and most preferably at least about 17 or more amino acids. The peptide preferably is not greater than about 200 amino acids, more preferably less than 150 amino acids and most preferably less than 100 amino acids. Preferably the peptide is from about 5 to about 200 amino acids. To be active, any polypeptide must have sufficient length to display biological and/or immunological activity.

The term "naturally occurring polypeptide" refers to polypeptides produced by cells that have not been genetically engineered and specifically contemplates various polypeptides arising from post-translational modifications of the polypeptide including, but not limited to, acetylation, carboxylation, glycosylation, phosphorylation, lipidation and acylation.

The term "translated protein coding portion" means a sequence which encodes for the full length protein which may include any leader sequence or any processing sequence.

The term "mature protein coding sequence" means a sequence which encodes a peptide or protein without a signal or leader sequence. The peptide may have been produced by processing in the cell which removes any leader/signal sequence. The peptide may be produced synthetically or the protein may have been produced using a polynucleotide only encoding for the mature protein coding sequence.

The term "derivative" refers to polypeptides chemically modified by such techniques as ubiquitination, labeling (e.g., with radionuclides or various enzymes), covalent polymer attachment such as pegylation (derivatization with polyethylene glycol) and insertion or substitution by chemical synthesis of amino acids such as ornithine, which do not normally occur in human proteins.

The term "variant"(or "analog") refers to any polypeptide differing from naturally occurring polypeptides by amino acid insertions, deletions, and substitutions, created using, e g., recombinant DNA techniques. Guidance in determining which amino acid residues may be replaced, added or deleted without abolishing activities of interest, may be found by comparing the sequence of the particular polypeptide with that of homologous peptides and minimizing the number of amino acid sequence changes made in regions of high homology (conserved regions) or by replacing amino acids with consensus sequence.

Alternatively, recombinant variants encoding these same or similar polypeptides may be synthesized or selected by making use of the "redundancy" in the genetic code. Various codon substitutions, such as the silent changes which produce various restriction sites, may be introduced to optimize cloning into a plasmid or viral vector or expression in a particular prokaryotic or eukaryotic system. Mutations in the polynucleotide sequence may be reflected in the polypeptide or domains of other peptides added to the polypeptide to modify the properties of any part of the polypeptide, to change characteristics such as ligand-binding affinities, interchain affinities, or degradation/turnover rate.

Preferably, amino acid "substitutions" are the result of replacing one amino acid with another amino acid having similar structural and/or chemical properties, i.e., conservative amino acid replacements. "Conservative" amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Insertions" or "deletions" are preferably in the range of about 1 to 20 amino acids, more preferably 1 to 10 amino acids. The variation allowed may be experimentally determined by systematically making insertions, deletions, or substitutions of amino acids in a polypeptide molecule using recombinant DNA techniques and assaying the resulting recombinant variants for activity.

Alternatively, where alteration of function is desired, insertions, deletions or non-conservative alterations can be engineered to produce altered polypeptides. Such alterations can, for example, alter one or more of the biological functions or biochemical characteristics of the polypeptides of the invention. For example, such alterations may change polypeptide characteristics such as ligand-binding affinities, interchain affinities, or degradation/turnover rate. Further, such alterations can be selected so as to generate polypeptides that are better suited for expression, scale up and the like in the host cells chosen for expression. For example, cysteine residues can be deleted or substituted with another amino acid residue in order to eliminate disulfide bridges.

The terms "purified" or "substantially purified" as used herein denotes that the indicated nucleic acid or polypeptide is present in the substantial absence of other biological macromolecules, e.g., polynucleotides, proteins, and the like. In one embodiment, the polynucleotide or polypeptide is purified such that it constitutes at least 95% by weight, more preferably at least 99% by weight, of the indicated biological macromolecules present (but water, buffers, and other small molecules, especially molecules having a molecular weight of less than 1000 daltons, can be present).

The term "isolated" as used herein refers to a nucleic acid or polypeptide separated from at least one other component (e.g., nucleic acid or polypeptide) present with the nucleic acid or polypeptide in its natural source. In one embodiment, the nucleic acid or polypeptide is found in the presence of (if anything) only a solvent, buffer, ion, or other component normally present in a solution of the same. The terms "isolated" and "purified" do not encompass nucleic acids or polypeptides present in their natural source.

The term "recombinant," when used herein to refer to a polypeptide or protein, means that a polypeptide or protein is derived from recombinant (e.g., microbial, insect, or mammalian) expression systems. "Microbial" refers to recombinant polypeptides or proteins made in bacterial or fungal (e.g., yeast) expression systems. As a product, "recombinant microbial" defines a polypeptide or protein essentially free of native endogenous substances and unaccompanied by associated native glycosylation. Polypeptides or proteins expressed in most bacterial cultures, e.g., E. coli, will be free of glycosylation modifications; polypeptides or proteins expressed in yeast will have a glycosylation pattern in general different from those expressed in mammalian cells.

The term "recombinant expression vehicle or vector" refers to a plasmid or phage or virus or vector, for expressing a polypeptide from a DNA (RNA) sequence. An expression vehicle can comprise a transcriptional unit comprising an assembly of (1) a genetic element or elements having a regulatory role in gene expression, for example, promoters or enhancers, (2) a structural or coding sequence which is transcribed into mRNA and translated into protein, and (3) appropriate transcription initiation and termination sequences. Structural units intended for use in yeast or eukaryotic expression systems preferably include a leader sequence enabling extracellular secretion of translated protein by a host cell. Alternatively, where recombinant protein is expressed without a leader or transport sequence, it may include an amino terminal methionine residue. This residue may or may not be subsequently cleaved from the expressed recombinant protein to provide a final product.

The term "recombinant expression system" means host cells which have stably integrated a recombinant transcriptional unit into chromosomal DNA or carry the recombinant transcriptional unit extrachromosomally. Recombinant expression systems as defined herein will express heterologous polypeptides or proteins upon induction of the regulatory elements linked to the DNA segment or synthetic gene to be expressed. This term also means host cells which have stably integrated a recombinant genetic element or elements having a regulatory role in gene expression, for example, promoters or enhancers. Recombinant expression systems as defined herein will express polypeptides or proteins endogenous to the cell upon induction of the regulatory elements linked to the endogenous DNA segment or gene to be expressed. The cells can be prokaryotic or eukaryotic.

The term "secreted" includes a protein that is transported across or through a membrane, including transport as a result of signal sequences in its amino acid sequence when it is expressed in a suitable host cell. "Secreted" proteins include without limitation proteins secreted wholly (e.g., soluble proteins) or partially (e.g., receptors) from the cell in which they are expressed. "Secreted" proteins also include without limitation proteins that are transported across the membrane of the endoplasmic reticulum. "Secreted" proteins are also intended to include proteins containing non-typical signal sequences (e.g. Interleukin-1 Beta, see Krasney, P. A. and Young, P. R. (1992) Cytokine 4(2):134–143) and factors released from damaged cells (e.g. Interleukin-1 Receptor Antagonist, see Arend, W. P. et. al. (1998) Annu. Rev. Immunol. 16:27–55)

Where desired, an expression vector may be designed to contain a "signal or leader sequence" which will direct the polypeptide through the membrane of a cell. Such a sequence may be naturally present on the polypeptides of the present invention or provided from heterologous protein sources by recombinant DNA techniques.

The term "stringent" is used to refer to conditions that are commonly understood in the art as stringent. Stringent conditions can include highly stringent conditions (i.e., hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C.), and moderately stringent conditions (i.e., washing in 0.2×SSC/0.1% SDS at 42° C.). Other exemplary hybridization conditions are described herein in the examples.

In instances of hybridization of deoxyoligonucleotides, additional exemplary stringent hybridization conditions include washing in 6×SSC/0.05% sodium pyrophosphate at 37° C. (for 14-base oligonucleotides), 48° C. (for 17-base oligos), 55° C. (for 20-base oligonucleotides), and 60° C. (for 23-base oligonucleotides).

As used herein, "substantially equivalent" can refer both to nucleotide and amino acid sequences, for example a mutant sequence, that varies from a reference sequence by one or more substitutions, deletions, or additions, the net effect of which does not result in an adverse functional dissimilarity between the reference and subject sequences. Typically, such a substantially equivalent sequence varies from one of those listed herein by no mote than about 35% (i.e., the number of individual residue substitutions, additions, and/or deletions in a substantially equivalent sequence, as compared to the corresponding reference sequence, divided by the total number of residues in the substantially equivalent sequence is about 0.35 or less). Such a sequence is said to have 65% sequence identity to the listed sequence. In one embodiment, a substantially equivalent, e.g., mutant, sequence of the invention varies from a listed sequence by no more than 30% (70% sequence identity); in a variation of this embodiment, by no more than 25% (75% sequence identity); and in a further variation of this embodiment, by no more than 20% (80% sequence identity) and in a further variation of this embodiment, by no more than 10% (90% sequence identity) and in a further variation of this embodiment, by no more that 5% (95% sequence identity). Substantially equivalent, e.g., mutant, amino acid sequences according to the invention preferably have at least.80% sequence identity with a listed amino acid sequence, more preferably at least 90% sequence identity. Substantially equivalent nucleotide sequences of the invention can have lower percent sequence identities, taking into account, for example, the redundancy or degeneracy of the genetic code. Preferably, nucleotide sequence has at least about 65% identity, more preferably at least about 75% identity, and most preferably at least about 95% identity. For the purposes of the present invention, sequences having substantially equivalent biological activity and substantially equivalent expression characteristics are considered substantially equivalent. For the purposes of determining equivalence, truncation of the mature sequence (e.g., via a mutation which creates a spurious stop codon) should be disregarded. Sequence identity may be determined, e.g., using the Jotun Hein method (Hein, J. (1990) Methods Enzymol. 183:626–645). Identity between sequences can also be determined by other methods known in the art, e.g. by varying hybridization conditions.

The term "totipotent" refers to the capability of a cell to differentiate into all of the cell types of an adult organism.

The term "transformation" means introducing DNA into a suitable host cell so that the DNA is replicable, either as an extrachromosomal element, or by chromosomal integration. The term "transfection" refers to the taking up of an expression vector by a suitable host cell, whether or not any coding sequences are in fact expressed. The term "infection" refers to the introduction of nucleic acids into a suitable host cell by use of a virus or viral vector.

As used herein, an "uptake modulating fragment," UMF, means a series of nucleotides which mediate the uptake of a linked DNA fragment into a cell. UMFs can be readily identified using known UMFs as a target sequence or target motif with the computer-based systems described below. The presence and activity of a UMF can be confirmed by attaching the suspected UMF to a marker sequence. The resulting nucleic acid molecule is then incubated with an appropriate host under appropriate conditions and the uptake of the marker sequence is determined. As described above, a UMF will increase the frequency of uptake of a linked marker sequence.

Each of the above terms is meant to encompass all that is described for each, unless the context dictates otherwise.

4.2 NUCLEIC ACIDS OF THE INVENTION

Nucleotide sequences of the invention are set forth in the Sequence Listing.

The isolated polynucleotides of the invention include a polynucleotide comprising the nucleotide sequences of the SEQ ID NO: 1–1104; a polynucleotide encoding any one of the peptide sequences of SEQ ID NO: 1–1104; and a polynucleotide comprising the nucleotide sequence encoding the mature protein coding sequence of the polynucleotides of any one of SEQ ID NO: 1–1104. The polynucleotides of the present invention also include, but are not limited to, a polynucleotide that hybridizes under stringent conditions to (a) the complement of any of the nucleotides sequences of the SEQ ID NO: 1–1104; (b) nucleotide sequences encoding any one of the amino acid sequences set forth in the Sequence Listing; (c) a polynucleotide which is an allelic variant of any polynucleotide recited above; (d) a polynucleotide which encodes a species homolog of any of the proteins recited above; or (e) a polynucleotide that encodes a polypeptide comprising a specific domain or truncation of the polypeptides of SEQ ID NO: 1–1104. Domains of interest may depend on the nature of the encoded polypeptide; e.g., domains in receptor-like polypeptides include ligand-binding, extracellular, transmembrane, or cytoplasmic domains, or combinations thereof; domains in immunoglobulin-like proteins include the variable immunoglobulin-like domains; domains in enzyme-like polypeptides include catalytic and substrate binding domains; and domains in ligand polypeptides include receptor-binding domains.

The polynucleotides of the invention include naturally occurring or wholly or partially synthetic DNA, e.g., cDNA and genomic DNA, and RNA, e.g., mRNA. The polynucleotides may include all of the coding region of the cDNA or may represent a portion of the coding region of the cDNA.

The present invention also provides genes corresponding to the cDNA sequences disclosed herein. The corresponding genes can be isolated in accordance with known methods using the sequence information disclosed herein. Such methods include the preparation of probes or primers from the disclosed sequence information for identification and/or amplification of genes in appropriate genomic libraries or other sources of genomic materials. Further 5' and 3' sequence can be obtained using methods known in the art. For example, full length cDNA or genomic DNA that corresponds to any of the polynucleotides of the SEQ ID NO: 1–1104 can be obtained by screening appropriate cDNA or genomic DNA libraries under suitable hybridization conditions using any of the polynucleotides of the SEQ ID NO: 1–1104 or a portion thereof as a probe. Alternatively, the polynucleotides of the SEQ ID NO: 1–1104 may be used as the basis for suitable primer(s) that allow identification and/or amplification of genes in appropriate genomic DNA or cDNA libraries.

The nucleic acid sequences of the invention can be assembled from ESTs and sequences (including cDNA and genomic sequences) obtained from one or more public databases, such as dbEST, gbpri, and UniGene. The EST sequences can provide identifying sequence information, representative fragment or segment information, or novel segment information for the full-length gene.

The polynucleotides of the invention also provide polynucleotides including nucleotide sequences that are substantially equivalent to the polynucleotides recited above. Polynucleotides according to the invention can have, e.g., at least about 65%, at least about 70%, at least about 75%, at least about 80%, more typically at least about 90%, and even more typically at least about 95%, sequence identity to a polynucleotide recited above.

Included within the scope of the nucleic acid sequences of the invention are nucleic acid sequence fragments that hybridize under stringent conditions to any of the nucleotide sequences of the SEQ ID NO: 1–1104, or complements thereof, which fragment is greater than about 5 nucleotides, preferably 7 nucleotides, more preferably greater than 9 nucleotides and most preferably greater than 17 nucleotides. Fragments of, e.g. 15, 17, or 20 nucleotides or more that are selective for (i.e. specifically hybridize to any one of the polynucleotides of the invention) are contemplated. Probes capable of specifically hybridizing to a polynucleotide can differentiate polynucleotide sequences of the invention from other polynucleotide sequences in the same family of genes or can differentiate human genes from genes of other species, and are preferably based on unique nucleotide sequences.

The sequences falling within the scope of the present invention are not limited to these specific sequences, but also include allelic and species variations thereof. Allelic and species variations can be routinely determined by comparing the sequence provided in SEQ ID NO: 1–1104, a representative fragment thereof, or a nucleotide sequence at least 90% identical, preferably 95% identical, to SEQ ID NOs: 1–1104 with a sequence from another isolate of the same species. Furthermore, to accommodate codon variability, the invention includes nucleic acid molecules coding for the same amino acid sequences as do the specific ORFs disclosed herein. In other words, in the coding region of an ORF, substitution of one codon for another codon that encodes the same amino acid is expressly contemplated.

The nearest neighbor result for the nucleic acids of the present invention, including SEQ ID NOs: 1–1104, can be obtained by searching a database using an algorithm or a program. Preferably, a BLAST which stands for Basic Local Alignment Search Tool is used to search for local sequence alignments (Altshul, S. F. J Mol. Evol. 36 290–300 (1993) and Altschul S. F. et al. J. Mol. Biol. 21:403410 (1990)). Alternatively a FASTA version 3 search against Genpept, using Fastxy algorithm.

Species homologs (or orthologs) of the disclosed polynucleotides and proteins are also provided by the present invention. Species homologs may be isolated and identified by making suitable probes or primers from the sequences provided herein and screening a suitable nucleic acid source from the desired species.

The invention also encompasses allelic variants of the disclosed polynucleotides or proteins; that is, naturally-occurring alternative forms of the isolated polynucleotide which also encode proteins which are identical, homologous or related to that encoded by the polynucleotides.

The nucleic acid sequences of the invention are further directed to sequences which encode variants of the described nucleic acids. These amino acid sequence variants may be prepared by methods known in the art by introducing appropriate nucleotide changes into a native or variant polynucleotide. There are two variables in the construction of amino acid sequence variants: the location of the mutation and the nature of the mutation. Nucleic acids encoding the amino acid sequence variants are preferably constructed by mutating the polynucleotide to encode an amino acid sequence that does not occur in nature. These nucleic acid alterations can be made at sites that differ in the nucleic acids from different species (variable positions) or in highly conserved regions (constant regions). Sites at such locations will typically be modified in series, e.g., by substituting first with conservative choices (e.g., hydrophobic amino acid to a different hydrophobic amino acid) and then with more distant choices (e.g., hydrophobic amino acid to a charged amino acid), and then deletions or insertions may be made at the target site. Amino acid sequence deletions generally range from about 1 to 30 residues, preferably about 1 to 10 residues, and are typically contiguous. Amino acid insertions include amino- and/or carboxyl-terminal fusions ranging in length from one to one hundred or more residues, as well as intrasequence insertions of single or multiple amino acid residues. Intrasequence insertions may range generally from about 1 to 10 amino residues, preferably from 1 to 5 residues. Examples of terminal insertions include the heterologous signal sequences necessary for secretion or for intracellular targeting in different host cells and sequences such as FLAG or poly-histidine sequences useful for purifying the expressed protein.

In a preferred method, polynucleotides encoding the novel amino acid sequences are changed via site-directed mutagenesis. This method uses oligonucleotide sequences to alter a polynucleotide to encode the desired amino acid variant, as well as sufficient adjacent nucleotides on both sides of the changed amino acid to form a stable duplex on either side of the site of being changed. In general, the techniques of site-directed mutagenesis are well known to those of skill in the art and this technique is exemplified by publications such as, Edelman et al., DNA 2:183 (1983). A versatile and efficient method for producing site-specific changes in a polynucleotide sequence was published by Zoller and Smith, *Nucleic Acids Res.* 10:6487–6500 (1982). PCR may also be used to create amino acid sequence variants of the novel nucleic acids. When small amounts of template DNA are used as starting material, primer(s) that differs slightly in sequence from the corresponding region in the template DNA can generate the desired amino acid variant. PCR amplification results in a population of product DNA fragments that differ from the polynucleotide template encoding the polypeptide at the position specified by the primer. The product DNA fragments replace the corresponding region in the plasmid and this gives a polynucleotide encoding the desired amino acid variant.

A further technique for generating amino acid variants is the cassette mutagenesis technique described in Wells et al., *Gene* 34:315 (1985); and other mutagenesis techniques well known in the art, such as, for example, the techniques in Sambrook et al., supra, and *Current Protocols in Molecular Biology*, Ausubel et al. Due to the inherent degeneracy of the genetic code, other DNA sequences which encode substantially the same or a functionally equivalent amino acid sequence may be used in the practice of the invention for the cloning and expression of these novel nucleic acids. Such DNA sequences include those which are capable of hybridizing to the appropriate novel nucleic acid sequence under stringent conditions.

Polynucleotides encoding preferred polypeptide truncations of the invention can be used to generate polynucleotides encoding chimeric or fusion proteins comprising one or more domains of the invention and heterologous protein sequences.

The polynucleotides of the invention additionally include the complement of any of the polynucleotides recited above. The polynucleotide can be DNA (genomic, cDNA, amplified, or synthetic) or RNA. Methods and algorithms for obtaining such polynucleotides are well known to those of skill in the art and can include, for. example, methods for determining hybridization conditions that can routinely isolate polynucleotides of the desired sequence identities.

In accordance with the invention, polynucleotide sequences comprising the mature protein coding sequences corresponding to any one of SEQ ID NO: 1–1104, or functional equivalents thereof, may be used to generate recombinant DNA molecules that direct the expression of that nucleic acid, or a functional equivalent thereof, in appropriate host cells. Also included are the cDNA inserts of any of the clones identified herein.

A polynucleotide according to the invention can be joined to any of a variety of other nucleotide sequences by well-established recombinant DNA techniques (see Sambrook J et al. (1989) Molecular Cloning: A Laboratory Manual, Cold Spring Harbor Laboratory, NY). Useful nucleotide sequences for joining to polynucleotides include an assortment of vectors, e.g., plasmids, cosmids, lambda phage derivatives, phagemids, and the like, that are well known in the art. Accordingly, the invention also provides a vector including a polynucleotide of the invention and a host cell containing the polynucleotide. In general, the vector contains an origin of replication functional in at least one organism, convenient restriction endonuclease sites, and a selectable marker for the host cell. Vectors according to the invention include expression vectors, replication vectors, probe generation vectors, and sequencing vectors. A host cell according to the invention can be a prokaryotic or eukaryotic cell and can be a unicellular organism or part of a multicellular organism.

The present invention further provides recombinant constructs comprising a nucleic acid having any of the nucleotide sequences of the SEQ ID NOs: 1–1104 or a fragment thereof or any other polynucleotides of the invention. In one embodiment, the recombinant constructs of the present invention comprise a vector, such as a plasmid or viral vector, into which a nucleic acid having any of the nucleotide sequences of the SEQ ID NOs: 1–1104 or a fragment thereof is inserted, in a forward or reverse orientation. In the case of a vector comprising one of the ORFs of the present invention, the vector may further comprise regulatory sequences, including for example, a promoter, operably linked to the ORF. Large numbers of suitable vectors and promoters are known to those of skill in the art and are commercially available for generating the recombinant constructs of the present invention. The following vectors are provided by way of example. Bacterial: pBs, phagescript, PsiX174, pBluescript SK, pBs KS, pNH8a, pNH16a, pNH18a, pNH46a (Stratagene); pTrc99A, pKK223-3, pKK233-3, pDR540, pRIT5 (Pharmacia). Eukaryotic: pWLneo, pSV2cat, pOG44, PXTI, pSG (Stratagene) pSVK3, pBPV, pMSG, pSVL (Pharmacia).

The isolated polynucleotide of the invention may be operably linked to an expression control sequence such as the pMT2 or pED expression vectors disclosed in Kaufman et al., Nucleic Acids Res. 19, 4485–4490 (1991), in order to produce the protein recombinantly. Many suitable expression control sequences are known in the art. General methods of expressing recombinant proteins are also known and are exemplified in R. Kaufman, Methods in Enzymology 185, 537–566 (1990). As defined herein "operably linked" means that the isolated polynucleotide of the invention and an expression control sequence are situated within a vector or cell in such a way that the protein is expressed by a host cell which has been transformed (transfected) with the ligated polynucleotide/expression control sequence.

Promoter regions can be selected from any desired gene using CAT (chloramphenicol transferase) vectors or other vectors with selectable markers. Two appropriate vectors are pKK232-8 and pCM7. Particular named bacterial promoters include lacI, lacZ, T3, T7, gpt, lambda PR, and trc. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art. Generally, recombinant expression vectors will include origins of replication and selectable markers permitting transformation of the host cell, e.g., the ampicillin resistance gene of *E. coli* and *S. cerevisiae* TRP1 gene, and a promoter derived from a highly-expressed gene to direct transcription of a downstream structural sequence. Such promoters can be derived from operons encoding glycolytic enzymes such as 3-phosphoglycerate kinase (PGK), a-factor, acid phosphatase, or heat shock proteins, among others. The heterologous structural sequence is assembled in appropriate phase with translation initiation and termination sequences, and preferably, a leader sequence capable of directing secretion of translated protein into the periplasmic space or extracellular medium. Optionally, the heterologous sequence can encode a fusion protein including an amino terminal identification peptide imparting desired characteristics, e.g., stabilization or simplified purification of expressed recombinant product. Useful expression vectors for bacterial use are constructed by inserting a structural DNA sequence encoding a desired protein together with suitable translation initiation and termination signals in operable reading phase with a functional promoter. The vector will comprise one or more phenotypic selectable markers and an origin of replication to ensure maintenance of the vector and to, if desirable, provide amplification within the host. Suitable prokaryotic hosts for transformation include *E. coli, Bacillus subtilis, Salmonella typhimurium* and various species within the genera *Pseudomonas, Streptomyces*, and *Staphylococcus*, although others may also be employed as a matter of choice.

As a representative but non-limiting example, useful expression vectors for bacterial use can comprise a selectable marker and bacterial origin of replication derived from commercially available plasmids comprising genetic elements of the well known cloning vector pBR322 (ATCC 37017). Such commercial vectors include, for example, pKK223-3 (Pharmacia Fine Chemicals, Uppsala, Sweden) and GEM 1 (Promega Biotech, Madison, Wis., USA). These pBR322 "backbone" sections are combined with an appropriate promoter and the structural sequence to be expressed. Following transformation of a suitable host strain and growth of the host strain to an appropriate cell density, the selected promoter is induced or derepressed by appropriate means (e.g., temperature shift or chemical induction) and cells are cultured for an additional period. Cells are typically harvested by centrifugation, disrupted by physical or chemical means, and the resulting crude extract retained for further purification.

Polynucleotides of the invention can also be used to induce immune responses. For example, as described in Fan et al., Nat. Biotech. 17:870–872 (1999), incorporated herein by reference, nucleic acid sequences encoding a polypeptide may be used to generate antibodies against the encoded polypeptide following topical administration of naked plasmid DNA or following injection, and preferably intramuscular injection of the DNA. The nucleic acid sequences are preferably inserted in a recombinant expression vector and may be in the form of naked DNA.

4.3 HOSTS

The present invention further provides host cells genetically engineered to contain the polynucleotides of the invention. For example, such host cells may contain nucleic acids of the invention introduced into the host cell using known transformation, transfection or infection methods. The present invention still further provides host cells genetically engineered to express the polynucleotides of the invention, wherein such polynucleotides are in operative association with a regulatory sequence heterologous to the host cell which drives expression of the polynucleotides in the cell.

Knowledge of nucleic acid sequences allows for modification of cells to permit, or increase, expression of endogenous polypeptide. Cells can be modified (e.g., by homologous recombination) to provide increased polypeptide expression by replacing, in whole or in part, the naturally occurring promoter with all or part of a heterologous promoter so that the cells express the polypeptide at higher levels. The heterologous promoter is inserted in such a manner that it is operatively linked to the encoding sequences. See, for example, PCT International Publication No. WO94/12650, PCT International Publication No. WO92/20808, and PCT International Publication No. WO91/09955. It is also contemplated that, in addition to heterologous promoter DNA, amplifiable marker DNA (e.g., ada, dhfr, and the multifunctional CAD gene which encodes carbamyl phosphate synthase, aspartate transcarbamylase, and dihydroorotase) and/or intron DNA may be inserted along with the heterologous promoter DNA. If linked to the coding sequence, amplification of the marker DNA by standard selection methods results in co-amplification of the desired protein coding sequences in the cells.

The host cell can be a higher eukaryotic host cell, such as a mammalian cell, a lower eukaryotic host cell, such as a yeast cell, or the host cell can be a prokaryotic cell, such as a bacterial cell. Introduction of the recombinant construct into the host cell can be effected by calcium phosphate transfection, DEAE, dextran mediated transfection, or electroporation (Davis, L. et al., Basic Methods in Molecular Biology (1986)). The host cells containing one of the polynucleotides of the invention, can be used in conventional manners to produce the gene product encoded by the isolated fragment (in the case of an ORF) or can be used to produce a heterologous protein under the control of the EMF.

Any host/vector system can be used to express one or more of the ORFs of the present invention. These include, but are not limited to, eukaryotic hosts such as HeLa cells, Cv-1 cell, COS cells, 293 cells, and Sf9 cells, as well as prokaryotic host such as E. coli and B. subtilis. The most preferred cells are those which do not normally express the particular polypeptide or protein or which expresses the polypeptide or protein at low natural level. Mature proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al., in Molecular Cloning: A Laboratory Manual, Second Edition, Cold Spring Harbor, N.Y. (1989), the disclosure of which is hereby incorporated by reference.

Various mammalian cell culture systems can also be employed to express recombinant protein. Examples of mammalian expression systems include the COS-7 lines of monkey kidney fibroblasts, described by Gluzman, Cell 23:175 (1981). Other cell lines capable of expressing a compatible vector are, for example, the C127, monkey COS cells, Chinese Hamster Ovary (CHO) cells, human kidney 293 cells, human epidermal A431 cells, human Colo205 cells, 3T3 cells, CV-1 cells, other transformed primate cell lines, normal diploid cells, cell strains derived from in vitro culture of primary tissue, primary explants, HeLa cells, mouse L cells, BHK, HL-60, U937, HaK or Jurkat cells. Mammalian expression vectors will comprise an origin of replication, a suitable promoter and also any necessary ribosome binding sites, polyadenylation site, splice donor and acceptor sites, transcriptional termination sequences, and 5' flanking nontranscribed sequences. DNA sequences derived from the SV40 viral genome, for example, SV40 origin, early promoter, enhancer, splice, and polyadenylation sites may be used to provide the required nontranscribed genetic elements. Recombinant polypeptides and proteins produced in bacterial culture are usually isolated by initial extraction from cell pellets, followed by one or more salting-out, aqueous ion exchange or size exclusion chromatography steps. Protein refolding steps can be used, as necessary, in completing configuration of the mature protein. Finally, high performance liquid chromatography (HPLC) can be employed for final purification steps. Microbial cells employed in expression of proteins can be disrupted by any convenient method, including freeze-thaw cycling, sonication, mechanical disruption, or use of cell lysing agents.

Alternatively, it may be possible to produce the protein in lower eukaryotes such as yeast or insects or in prokaryotes such as bacteria. Potentially suitable yeast strains include Saccharomyces cerevisiae, Schizosaccharomyces pombe, Kluyveromyces strains, Candida, or any yeast strain capable of expressing heterologous proteins. Potentially suitable bacterial strains include Escherichia coli, Bacillus subtilis, Salmonella typhimurium, or any bacterial strain capable of expressing heterologous proteins. If the protein is made in yeast or bacteria, it may be necessary to modify the protein produced therein, for example by phosphorylation or glycosylation of the appropriate sites, in order to obtain the functional protein. Such covalent attachments may be accomplished using known chemical or enzymatic methods.

In another embodiment of the present invention, cells and tissues may be engineered to express an endogenous gene comprising the polynucleotides of the invention under the control of inducible regulatory elements, in which case the regulatory sequences of the endogenous gene may be replaced by homologous recombination. As described herein, gene targeting can be used to replace a gene's existing regulatory region with a regulatory sequence isolated from a different gene or a novel regulatory sequence synthesized by genetic engineering methods. Such regulatory sequences may be comprised of promoters, enhancers, scaffold-attachment regions, negative regulatory elements, transcriptional initiation sites, regulatory protein binding sites or combinations of said sequences. Alternatively, sequences which affect the structure or stability of the RNA or protein produced may be replaced, removed, added, or otherwise modified by targeting. These sequence include polyadenylation signals, mRNA stability elements, splice sites, leader sequences for enhancing or modifying transport or secretion properties of the protein, or other sequences which alter or improve the function or stability of protein or RNA molecules.

The targeting event may be a simple insertion of the regulatory sequence, placing the gene under the control of the new regulatory sequence, e.g., inserting a new promoter or enhancer or both upstream of a gene. Alternatively, the targeting event may be a simple deletion of a regulatory element, such as the deletion of a tissue-specific negative regulatory element. Alternatively, the targeting event may replace an existing element; for example, a tissue-specific enhancer can be replaced by an enhancer that has broader or different cell-type specificity than the naturally occurring elements. Here, the naturally occurring sequences are deleted and new sequences are added. In all cases, the identification of the targeting event may be facilitated by the use of one or more selectable marker genes that are contiguous with the targeting DNA, allowing for the selection of cells in which the exogenous DNA has integrated into the host cell genome. The identification of the targeting event may also be facilitated by the use of one or more marker genes exhibiting the property of negative selection, such that the negatively selectable marker is linked to the exogenous DNA, but configured such that the negatively selectable marker flanks the targeting sequence, and such that a correct homologous recombination event with sequences in the host cell genome does not result in the stable integration of the negatively selectable marker. Markers useful for this purpose include the Herpes Simplex Virus thymidine kinase (TK) gene or the bacterial xanthine-guanine phosphoribosyl-transferase (gpt) gene.

The gene targeting or gene activation techniques which can be used in accordance with this aspect of the invention are more particularly described in U.S. Pat. No. 5,272,071 to Chappel; U.S. Pat. No. 5,578,461 to Sherwin et al.; International Application No. PCT/US92/09627 (WO93/09222) by Selden et al.; and International Application No. PCT/US90/06436 (WO91/06667) by Skoultchi et al., each of which is incorporated by reference herein in its entirety.

4.4 POLYPEPTIDES OF THE INVENTION

The isolated polypeptides of the invention include, but are not limited to, a polypeptide comprising: the amino acid sequences set forth as any one of SEQ ID NO: 1–1104 or an amino acid sequence encoded by any one of the nucleotide sequences SEQ ID NOs: 1–1104 or the corresponding full length or mature protein. Polypeptides of the invention also include polypeptides preferably with biological or immunological activity that are encoded by: (a) a polynucleotide having any one of the nucleotide sequences set forth in the SEQ ID NOs: 1–1104 or (b) polynucleotides encoding any one of the amino acid sequences set forth as SEQ ID NO: 1–1104 or (c) polynucleotides that hybridize to the complement of the polynucleotides of either (a) or (b) under stringent hybridization conditions. The invention also provides biologically active or immunologically active variants of any of the amino acid sequences set forth as SEQ ID NO: 1–1104 or the corresponding full length or mature protein; and "substantial equivalents" thereof (e.g., with at least about 65%, at least about 70%, at least about 75%, at least about 80%, at least about 85%, at least about 90%, typically at least about 95%, more typically at least about 98%, or most typically at least about 99% amino acid identity) that retain biological activity. Polypeptides encoded by allelic variants may have a similar, increased, or decreased activity compared to polypeptides comprising SEQ ID NO: 1–1104.

Fragments of the proteins of the present invention which are capable of exhibiting biological activity are also encompassed by the present invention. Fragments of the protein may be in linear form or they may be cyclized using known methods, for example, as described in H. U. Saragovi, et al., Bio/Technology 10, 773–778 (1992) and in R. S. McDowell, et al., J. Amer. Chem. Soc. 114, 9245–9253 (1992), both of which are incorporated herein by reference. Such fragments may be fused to carrier molecules such as immunoglobulins for many purposes, including increasing the valency of protein binding sites.

The present invention also provides both full-length and mature forms (for example, without a signal sequence or precursor sequence) of the disclosed proteins. The protein coding sequence is identified in the sequence listing by translation of the disclosed nucleotide sequences. The mature form of such protein may be obtained by expression of a full-length polynucleotide in a suitable mammalian cell or other host cell. The sequence of the mature form of the protein is also determinable from the amino acid sequence of the full-length form. Where proteins of the present invention are membrane bound, soluble forms of the proteins are also provided. In such forms, part or all of the regions causing the proteins to be membrane bound are deleted so that the proteins are fully secreted from the cell in which it is expressed.

Protein compositions of the present invention may further comprise an acceptable carrier, such as a hydrophilic, e.g., pharmaceutically acceptable, carrier.

The present invention further provides isolated polypeptides encoded by the nucleic acid fragments of the present invention or by degenerate variants of the nucleic acid fragments of the present invention. By "degenerate variant" is intended nucleotide fragments which differ from a nucleic acid fragment of the present invention (e.g., an ORF) by nucleotide sequence but, due to the degeneracy of the genetic code, encode an identical polypeptide sequence. Preferred nucleic acid fragments of the present invention are the ORFs that encode proteins.

A variety of methodologies known in the art can be utilized to obtain any one of the isolated polypeptides or proteins of the present invention. At the simplest level, the amino acid sequence can be synthesized using commercially available peptide synthesizers. The synthetically-constructed protein sequences, by virtue of sharing primary, secondary or tertiary structural and/or conformational characteristics with proteins may possess biological properties in common therewith, including protein activity. This technique is particularly useful in producing small peptides and fragments of larger polypeptides. Fragments are useful, for example, in generating antibodies against the native polypeptide. Thus, they may be employed as biologically active or immunological substitutes for natural, purified proteins in screening of therapeutic compounds and in immunological processes for the development of antibodies.

The polypeptides and proteins of the present invention can alternatively be purified from cells which have been altered to express the desired polypeptide or protein. As used herein, a cell is said to be altered to express a desired polypeptide or protein when the cell, through genetic manipulation, is made to produce a polypeptide or protein which it normally does not produce or which the cell normally produces at a lower level. One skilled in the art can readily adapt procedures for introducing and expressing either recombinant or synthetic sequences into eukaryotic or prokaryotic cells in order to generate a cell which produces one of the polypeptides or proteins of the present invention.

The invention also relates to methods for producing a polypeptide comprising growing a culture of host cells of the invention in a suitable culture medium, and purifying the protein from the cells or the culture in which the cells are grown. For example, the methods of the invention include a process for producing a polypeptide in which a host cell containing a suitable expression vector that includes a polynucleotide of the invention is cultured under conditions that allow expression of the encoded polypeptide. The polypeptide can be recovered from the culture, conveniently from the culture medium, or from a lysate prepared from the host cells and further purified. Preferred embodiments include those in which the protein produced by such process is a full length or mature form of the protein.

In an alternative method, the polypeptide or protein is purified from bacterial cells which naturally produce the polypeptide or protein. One skilled in the art can readily follow known methods for isolating polypeptides and proteins in order to obtain one of the isolated polypeptides or proteins of the present invention. These include, but are not limited to, immunochromatography, HPLC, size-exclusion chromatography, ion-exchange chromatography, and immuno-affinity chromatography. See, e.g., Scopes, *Protein Purification: Principles and Practice*, Springer-Verlag (1994); Sambrook, et al., in Molecular Cloning: *A Laboratory Manual*; Ausubel et al., *Current Protocols in Molecular Biology*. Polypeptide fragments that retain biological/immunological activity include fragments comprising greater than about 100 amino acids, or greater than about 200 amino acids, and fragments that encode specific protein domains.

The purified polypeptides can be used in in vitro binding assays which are well known in the art to identify molecules which bind to the polypeptides. These molecules include but are not limited to, for e.g., small molecules, molecules from combinatorial libraries, antibodies or other proteins. The molecules identified in the binding assay are then tested for antagonist or agonist activity in in vivo tissue culture or animal models that are well known in the art. In brief, the molecules are titrated into a plurality of cell cultures or animals and then tested for either cell/animal death or prolonged survival of the animal/cells.

In addition, the peptides of the invention or molecules capable of binding to the peptides may be complexed with toxins, e.g., ricin or cholera, or with other compounds that are toxic to cells. The toxin-binding molecule complex is then targeted to a tumor or other cell by the specificity of the binding molecule for SEQ ID NO: 1–1104.

The protein of the invention may also be expressed as a product of transgenic animals, e.g., as a component of the milk of transgenic cows, goats, pigs, or sheep which are characterized by somatic or germ cells containing a nucleotide sequence encoding the protein.

The proteins provided herein also include proteins characterized by amino acid sequences similar to those of purified proteins but into which modification are naturally provided or deliberately engineered. For example, modifications, in the peptide or DNA sequence, can be made by those skilled in the art using known techniques. Modifications of interest in the protein sequences may include the alteration, substitution, replacement, insertion or deletion of a selected amino acid residue in the coding sequence. For example, one or more of the cysteine residues may be deleted or replaced with another amino acid to alter the conformation of the molecule. Techniques for such alteration, substitution, replacement, insertion or deletion are well known to those skilled in the art (see, e.g., U.S. Pat. No. 4,518,584). Preferably, such alteration, substitution, replacement, insertion or deletion retains the desired activity of the protein. Regions of the protein that are important for the protein function can be determined by various methods known in the art including the alanine-scanning method which involved systematic substitution of single or strings of amino acids with alanine, followed by testing the resulting alanine-containing variant for biological activity. This type of analysis determines the importance of the substituted amino acid(s) in biological activity. Regions of the protein that are important for protein function may be determined by the eMATRIX program.

Other fragments and derivatives of the sequences of proteins which would be expected to retain protein activity in whole or in part and are useful for screening or other immunological methodologies may also be easily made by those skilled in the art given the disclosures herein. Such modifications are encompassed by the present invention.

The protein may also be. produced by operably linking the isolated polynucleotide of the invention to suitable control sequences in one or more insect expression vectors, and employing an insect expression system. Materials and methods for baculovirus/insect cell expression systems are commercially available in kit form from, e.g., Invitrogen, San Diego, Calif., U.S.A. (the MaxBat™ kit), and such methods are well known in the art, as described in Summers and Smith, Texas Agricultural Experiment Station Bulletin No. 1555 (1987), incorporated herein by reference. As used herein, an insect cell capable of expressing a polynucleotide of the present invention is "transformed."

The protein of the invention may be prepared by culturing transformed host cells under culture conditions suitable to express the recombinant protein. The resulting expressed protein may then be purified from such culture (i.e., from culture medium or cell extracts) using known purification processes, such as gel filtration and ion exchange chromatography. The purification of the protein may also include an affinity column containing agents which will bind to the protein; one or more column steps over such affinity resins as concanavalin A-agarose, heparin-toyopearl™ or Cibacrom blue 3GA Sepharose™; one or more steps involving hydrophobic interaction chromatography using such resins as phenyl ether, butyl ether, or propyl ether; or immunoaffinity chromatography.

Alternatively, the protein of the invention may also be expressed in a form which will facilitate purification. For example, it may be expressed as a fusion protein, such as those of maltose binding protein (MBP), glutathione-S-transferase (GST) or thioredoxin (TRX), or as a His tag. Kits for expression and purification of such fusion proteins are commercially available from New England BioLab (Beverly, Mass.), Pharmacia (Piscataway, N.J.) and Invitrogen, respectively. The protein can also be tagged with an epitope and subsequently purified by using a specific antibody directed to such epitope. One such epitope ("FLAG®") is commercially available from Kodak (New Haven, Conn.).

Finally, one or more reverse-phase high performance liquid chromatography (RP-HPLC) steps employing hydrophobic RP-HPLC media, e.g., silica gel having pendant methyl or other aliphatic groups, can be employed to further purify the protein. Some or all of the foregoing purification steps, in various combinations, can also be employed to provide a substantially homogeneous isolated recombinant protein. The protein thus purified is substantially free of other mammalian proteins and is defined in accordance with the present invention as an "isolated protein."

The polypeptides of the invention include analogs (variants). This embraces fragments, as well as peptides in which one or more amino acids has been deleted, inserted, or substituted. Also, analogs of the polypeptides of the invention embrace fusions of the polypeptides or modifications of the polypeptides of the invention, wherein the polypeptide or analog is fused to another moiety or moieties, e.g., targeting moiety or another therapeutic agent. Such analogs may exhibit improved properties such as activity and/or stability. Examples of moieties which may be fused to the polypeptide or an analog include, for example, targeting moieties which provide for the delivery of polypeptide to pancreatic cells, e.g., antibodies to pancreatic cells, antibodies to immune cells such as T-cells, monocytes, dendritic cells, granulocytes, etc., as well as receptor and ligands expressed on pancreatic or immune cells. Other moieties which may be fused to the polypeptide include therapeutic agents which are used for treatment, for example, immunosuppressive drugs such as cyclosporin, SK506, azathioprine, CD3 antibodies and steroids. Also, polypeptides may be fused to immune modulators, and other cytokines such as alpha or beta interferon.

4.4.1 DETERMINING POLYPEPTIDE AND POLYNUCLEOTIDE IDENTITY AND SIMILARITY

Preferred identity and/or similarity are designed to give the largest match between the sequences tested. Methods to determine identity and similarity are codified in computer programs including, but are not limited to, the GCG program package, including GAP (Devereux, J., et al., Nucleic Acids Research 12(1):387 (1984); Genetics Computer Group, University of Wisconsin, Madison, Wis.), BLASTP, BLASTN, BLASTX, FASTA (Altschul, S. F. et al., *J. Molec. Biol.* 215:403–410 (1990), PSI-BLAST (Altschul S. F. et al., Nucleic Acids Res. vol. 25, pp. 3389–3402, herein incorporated by reference), eMatrix software (Wu et al., J. Comp. Biol., vol. 6, pp. 219–235 (1999), herein incorporated by reference), eMotif software (Nevill-Manning et al, ISMB-97, vol 4, pp. 202–209, herein incorporated by reference) and the Kyte-Doolittle hydrophobocity prediction algorithm (*J. Mol Biol*, 157, pp. 105–31 (1982), incorporated herein by reference). The BLAST programs are publicly available from the National Center for Biotechnology Information (NCBI) and other sources (BLAST Manual, Altschul, S., et al. NCB NLM NIH Bethesda, Md. 20894; Altschul, S., et al., *J. Mol. Biol.* 215:403–410 (1990).

4.5 GENE THERAPY

Mutations in the polynucleotides of the invention gene may result in loss of normal function of the encoded protein. The invention thus provides gene therapy to restore normal activity of the polypeptides of the invention; or to treat disease states involving polypeptides of the invention. Delivery of a functional gene encoding polypeptides of the invention to appropriate cells is effected ex vivo, in situ, or in vivo by use of vectors, and more particularly viral vectors (e.g., adenovirus, adeno-associated virus, or a retrovirus), or.ex vivo by use of physical DNA transfer methods (e.g., liposomes or chemical treatments). See, for example, Anderson, Nature, supplement to vol. 392, no. 6679, pp.25–20 (1998). For additional reviews of gene therapy technology see Friedmann, Science, 244: 1275–1281 (1989); Verma, Scientific American: 68–84 (1990); and Miller, Nature, 357: 455–460 (1992). Introduction of any one of the nucleotides of the present invention or a gene encoding the polypeptides of the present invention can also be accomplished with extrachromosomal substrates (transient expression) or artificial chromosomes (stable expression). Cells may also be cultured ex vivo in the presence of proteins of the present invention in order to proliferate or to produce a desired effect on or activity in such cells. Treated cells can then be introduced in vivo for therapeutic purposes. Alternatively, it is contemplated that in other human disease states, preventing the expression of or inhibiting the activity of polypeptides of the invention will be useful in treating the disease states. It is contemplated that antisense therapy or gene therapy could be applied to negatively regulate the expression of polypeptides of the invention.

Other methods inhibiting expression of a protein include the introduction of antisense molecules to the nucleic acids of the present invention, their complements, or their translated RNA sequences, by methods known in the art. Further, the polypeptides of the present invention can be inhibited by using targeted deletion methods, or the insertion of a negative regulatory element such as a silencer, which is tissue specific.

The present invention still further provides cells genetically engineered in vivo to express the polynucleotides of the invention, wherein such polynucleotides are in operative association with a regulatory sequence heterologous to the host cell which drives expression of the polynucleotides in the cell. These methods can be used to increase or decrease the expression of the polynucleotides of the present invention.

Knowledge of DNA sequences provided by the invention allows for modification of cells to permit, increase, or decrease, expression of endogenous polypeptide. Cells can be modified (e.g., by homologous recombination) to provide increased polypeptide expression by replacing, in whole or in part, the naturally occurring promoter with all or part of a heterologous promoter so that the cells express the protein at higher levels. The heterologous promoter is inserted in such a manner that it is operatively linked to the desired protein encoding sequences. See, for example, PCT International Publication No. WO 94/12650, PCT International Publication No. WO 92/20808, and PCT International Publication No. WO 91/09955. It is also contemplated that, in addition to heterologous promoter DNA, amplifiable marker DNA (e.g., ada, dhfr, and the multifunctional CAD gene which encodes carbamyl phosphate synthase, aspartate transcarbamylase, and dihydroorotase) and/or intron DNA may be inserted along with the heterologous promoter DNA. If linked to the desired protein coding sequence, amplification of the marker DNA by standard selection methods results in co-amplification of the desired protein coding sequences in the cells.

In another embodiment of the present invention, cells and tissues may be engineered to express an endogenous gene comprising the polynucleotides of the invention under the control of inducible regulatory elements, in which case the regulatory sequences of the endogenous gene may be replaced by homologous recombination. As described herein, gene targeting can be used to replace a gene's existing regulatory region with a regulatory sequence isolated from a different gene or a novel regulatory sequence synthesized by genetic engineering methods. Such regulatory sequences may be comprised of promoters, enhancers, scaffold-attachment regions, negative regulatory elements, transcriptional initiation sites, regulatory protein binding sites or combinations of said sequences. Alternatively, sequences which affect the structure or stability of the RNA or protein produced may be replaced, removed, added, or otherwise modified by targeting. These sequences include polyadenylation signals, mRNA stability elements, splice sites, leader sequences for enhancing or modifying transport or secretion properties of the protein, or other sequences which alter or improve the function or stability of protein or RNA molecules.

The targeting event may be a simple insertion of the regulatory sequence, placing the gene under the control of the new regulatory sequence, e.g., inserting a new promoter or enhancer or both upstream of a gene. Alternatively, the targeting event may be a simple deletion of a regulatory element, such as the deletion of a tissue-specific negative regulatory element. Alternatively, the targeting event may replace an existing element; for example, a tissue-specific enhancer can be replaced by an enhancer that has broader or different cell-type specificity than the naturally occurring elements. Here, the naturally occurring sequences are deleted and new sequences are added. In all cases, the identification of the targeting event may be facilitated by the use of one or more selectable marker genes that are contiguous with the targeting DNA, allowing for the selection of cells in which the exogenous DNA has integrated into the cell genome. The identification of the targeting event may also be facilitated by the use of one or more marker genes exhibiting the property of negative selection, such that the negatively selectable marker is linked to the exogenous DNA, but configured such that the negatively selectable marker flanks the targeting sequence, and such that a correct homologous recombination event with sequences in the host cell genome does not result in the stable integration of the negatively selectable marker. Markers useful for this purpose include the Herpes Simplex Virus thymidine kinase (TK) gene or the bacterial xanthine-guanine phosphoribosyl-transferase (gpt) gene.

The gene targeting or gene activation techniques which can be used in accordance with this aspect of the invention are more particularly described in U.S. Pat. No. 5,272,071 to Chappel; U.S. Pat. No. 5,578,461 to Sherwin et al.; International Application No. PCT/US92/09627 (WO93/09222) by Selden et al.; and International Application No. PCT/US90/06436 (WO91/06667) by Skoultchi et al., each of which is incorporated by reference herein in its entirety.

4.6 TRANSGENIC ANIMALS

In preferred methods to determine biological functions of the polypeptides of the invention in vivo, one or more genes provided by the invention are either over expressed or inactivated in the germ line of animals using homologous recombination [Capecchi, Science 244:1288–1292 (1989)]. Animals in which the gene is over expressed, under the regulatory control of exogenous or endogenous promoter elements, are known as transgenic animals. Animals in which an endogenous gene has been inactivated by homologous recombination are referred to as "knockout" animals. Knockout animals, preferably non-human mammals, can be prepared as described in U.S. Pat. No. 5,557,032, incorporated herein by reference. Transgenic animals are useful to determine the roles polypeptides of the invention play in biological processes, and preferably in disease states. Transgenic animals are useful as model systems to identify compounds that modulate lipid metabolism. Transgenic animals, preferably non-human mammals, are produced using methods as described in U.S. Pat. No 5,489,743 and PCT Publication No. WO94/28122, incorporated herein by reference.

Transgenic animals can be prepared wherein all or part of a promoter of the polynucleotides of the invention is either activated or inactivated to alter the level of expression of the polypeptides of the invention. Inactivation can be carried out using homologous recombination methods described above. Activation can be achieved by supplementing or even replacing the homologous promoter to provide for increased protein expression. The homologous promoter can be supplemented by insertion of one or more heterologous enhancer elements known to confer promoter activation in a particular tissue.

The polynucleotides of the present invention also make possible the development, through, e.g., homologous recombination or knock out strategies, of animals that fail to express polypeptides of the invention or that express a variant polypeptide. Such animals are useful as models for studying the in vivo activities of polypeptide as well as for studying modulators of the polypeptides of the invention.

In preferred methods to determine biological functions of the polypeptides of the invention in vivo, one or more genes provided by the invention are either over expressed or inactivated in the germ line of animals using homologous recombination [Capecchi, Science 244:1288–1292 (1989)]. Animals in which the gene is over expressed, under the regulatory control of exogenous or endogenous promoter elements, are known as transgenic animals. Animals in which an endogenous gene has been inactivated by homologous recombination are referred to as "knockout" animals. Knockout animals, preferably non-human mammals, can be prepared as described in U.S. Pat. No. 5,557,032, incorporated herein by reference. Transgenic animals are useful to determine the roles polypeptides of the invention play in biological processes, and preferably in disease states. Transgenic animals are useful as model systems to identify compounds that modulate lipid metabolism. Transgenic animals, preferably non-human mammals, are produced using methods as described in U.S. Pat. No 5,489,743 and PCT Publication No. WO94/28122, incorporated herein by reference.

Transgenic animals can be prepared wherein all or part of the polynucleotides of the invention promoter is either activated or inactivated to alter the level of expression of the polypeptides of the invention. Inactivation can be carried out using homologous recombination methods described above. Activation can be achieved by supplementing or even replacing the homologous promoter to provide for increased protein expression. The homologous promoter can be supplemented by insertion of one or more heterologous enhancer elements known to confer promoter activation in a particular tissue.

4.7 USES AND BIOLOGICAL ACTIVITY

The polynucleotides and proteins of the present invention are expected to exhibit one or more of the uses or biological activities (including those associated with assays cited herein) identified herein. Uses or activities described for proteins of the present invention may be provided by administration or use of such proteins or of polynucleotides encoding such proteins (such as, for example, in gene therapies or vectors suitable for introduction of DNA). The mechanism underlying the particular condition or pathology will dictate whether the polypeptides of the invention, the polynucleotides of the invention or modulators (activators or inhibitors) thereof would be beneficial to the subject in need of treatment. Thus, "therapeutic compositions of the invention" include compositions comprising isolated polynucleotides (including recombinant DNA molecules, cloned genes and degenerate variants thereof) or polypeptides of the invention (including full length protein, mature protein and truncations or domains thereof), or compounds and other substances that modulate the overall activity of the target gene products, either at the level of target gene/protein expression or target protein activity. Such modulators include polypeptides, analogs, (variants), including fragments and fusion proteins, antibodies and other binding proteins; chemical compounds that directly or indirectly activate or inhibit the polypeptides of the invention (identified, e.g., via drug screening assays as described herein); antisense polynucleotides and polynucleotides suitable for triple helix formation; and in particular antibodies or other binding partners that specifically recognize one or more epitopes of the polypeptides of the invention.

The polypeptides of the present invention may likewise be involved in cellular activation or in one of the other physiological pathways described herein.

4.7.1 RESEARCH USES AND UTILITIES

The polynucleotides provided by the present invention can be used by the research community for various purposes. The polynucleotides can be used to express recombinant protein for analysis, characterization or therapeutic use; as markers for tissues in which the corresponding protein is preferentially expressed (either constitutively or at a particular stage of tissue differentiation or development or in disease states); as molecular weight markers on gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; as a probe to "subtract-out" known sequences in the process of discovering other novel polynucleotides; for selecting and making oligomers for attachment to a "gene chip" or other support, including for examination of expression patterns; to raise anti-protein antibodies using DNA immunization techniques; and as an antigen to raise anti-DNA antibodies or elicit another immune response. Where the polynucleotide encodes a protein which binds or potentially binds to another protein (such as, for example, in a receptor-ligand interaction), the polynucleotide can also be used in interaction trap assays (such as, for example, that described in Gyuris et al., Cell 75:791–803 (1993)) to identify polynucleotides encoding the other protein with which binding occurs or to identify inhibitors of the binding interaction.

The polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding polypeptide is preferentially expressed (either constitutively or at a particular stage of tissue differentiation or development or in a disease state); and, of course, to isolate correlative receptors or ligands. Proteins involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning: A Laboratory Manual", 2d ed., Cold Spring Harbor Laboratory Press, Sambrook, J., E. F. Fritsch and T. Maniatis eds., 1989, and "Methods in Enzymology: Guide to Molecular Cloning Techniques", Academic Press, Berger, S. L. and A. R. Kimmel eds., 1987.

4.7.2 NUTRITIONAL USES

Polynucleotides and polypeptides of the present invention can also be used as nutritional sources or supplements. Such uses include without limitation use as a protein or amino acid supplement, use as a carbon source, use as a nitrogen source and use as a source of carbohydrate. In such cases the polypeptide or polynucleotide of the invention can be added to the feed of a particular organism or can be administered as a separate solid or liquid preparation, such as in the form of powder, pills, solutions, suspensions or capsules. In the case of microorganisms, the polypeptide or polynucleotide of the invention can be added to the medium in or on which the microorganism is cultured.

4.7.3 CYTOKINE AND CELL PROLIFERATION/DIFFERENTIATION ACTIVITY

A polypeptide of the present invention may exhibit activity relating to cytokine, cell proliferation (either inducing or inhibiting) or cell differentiation (either inducing or inhibiting) activity or may induce production of other cytokines in certain cell populations. A polynucleotide of the invention can encode a polypeptide exhibiting such attributes. Many protein factors discovered to date, including all known cytokines, have exhibited activity in one or more factor-dependent cell proliferation assays, and hence the assays serve as a convenient confirmation of cytokine activity. The activity of therapeutic compositions of the present invention is evidenced by any one of a number of routine factor dependent cell proliferation assays for cell lines including, without limitation, 32D, DA2, DA1G, T10, B9, B9/11, BaF3, MC9/G, M+(preB M+), 2E8, RB5, DA1, 123, T1165, HT2, CTLL2, TF-1, Mo7e, CMK, HUVEC, and Caco. Therapeutic compositions of the invention can be used in the following:

Assays for T-cell or thymocyte proliferation include without limitation those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Takai et al., J. Immunol. 137:3494–3500, 1986; Bertagnolli et al., J. Immunol. 145:1706–1712, 1990; Bertagnolli et al., Cellular Immunology 133:327–341, 1991; Bertagnolli, et al., I. Immunol. 149:3778–3783, 1992; Bowman et al., I. Immunol. 152:1756–1761, 1994.

Assays for cytokine production and/or proliferation of spleen cells, lymph node cells or thymocytes include, without limitation, those described in: Polyclonal T cell stimulation, Kruisbeek, A. M. and Shevach, E. M. In Current Protocols in Immunology. J. E. e.a. Coligan eds. Vol 1 pp. 3.12.1–3.12.14, John Wiley and Sons, Toronto. 1994; and Measurement of mouse and human interleukin-γ, Schreiber, R. D. In Current Protocols in Immunology. J. E. e.a. Coligan eds. Vol 1 pp. 6.8.1–6.8.8, John Wiley and Sons, Toronto. 1994.

Assays for proliferation and differentiation of hematopoietic and lymphopoietic cells include, without limitation, those described in: Measurement of Human and Murine Interleukin 2 and Interleukin 4, Bottomly, K., Davis, L. S. and Lipsky, P. E. In Current Protocols in Immunology. J. E. e.a. Coligan eds. Vol 1 pp. 6.3.1–6.3.12, John Wiley and Sons, Toronto. 1991; deVries et al., J. Exp. Med. 173:1205–1211, 1991; Moreau et al., Nature 336:690–692, 1988; Greenberger et al., Proc. Natl. Acad. Sci. U.S.A. 80:2931–2938, 1983; Measurement of mouse and human interleukin 6—Nordan, R. In Current Protocols in Immunology. J. E. Coligan eds. Vol 1 pp. 6.6.1–6.6.5, John Wiley and Sons, Toronto. 1991; Smith et al., Proc. Natl. Aced. Sci. U.S.A. 83:1857–1861, 1986; Measurement of human Interleukin 11—Bennett, F., Giannotti, J., Clark, S. C. and Turner, K. J. In Current Protocols in Immunology. J. E. Coligan eds. Vol 1 pp. 6.15.1 John Wiley and Sons, Toronto. 1991; Measurement of mouse and human Interleukin 9—Ciarletta, A., Giannotti, J., Clark, S. C. and Turner, K. J. In Current Protocols in Immunology. J. E. Coligan eds. Vol 1 pp. 6.13.1, John Wiley and Sons, Toronto. 1991.

Assays for T-cell clone responses to antigens (which will identify, among others, proteins that affect APC-T cell interactions as well as direct T-cell effects by measuring proliferation and cytokine production) include, without limitation, those described in: Current Protocols in Immunology, Ed by J. E. Coligan, A. M. Kruisbeek, D. H. Margulies, E. M. Shevach, W Strober, Pub. Greene Publishing Associates and Wiley-Interscience (Chapter 3, In Vitro assays for Mouse Lymphocyte Function; Chapter 6, Cytokines and their cellular receptors; Chapter 7, Immunologic studies in Humans); Weinberger et al., Proc. Natl. Acad. Sci. USA 77:6091–6095, 1980; Weinberger et al., Eur. J. Immun. 11:405–411, 1981; Takai et al., J. Immunol. 137:3494–3500, 1986; Takai et al., J. Immunol. 140:508–512, 1988.

4.7.4 STEM CELL GROWTH FACTOR ACTIVITY

A polypeptide of the present invention may exhibit stem cell growth factor activity and be involved in the proliferation, differentiation and survival of pluripotent and totipotent stem cells including primordial germ cells, embryonic stem cells, hematopoietic stem cells and/or germ line stem cells. Administration of the polypeptide of the invention to stem cells in vivo or ex vivo is expected to maintain and expand cell populations in a totipotential or pluripotential state which would be useful for re-engineering damaged or diseased tissues, transplantation, manufacture of bio-pharmaceuticals and the development of bio-sensors. The ability to produce large quantities of human cells has important working applications for the production of human proteins which currently must be obtained from non-human sources or donors, implantation of cells to treat diseases such as Parkinson's, Alzheimer's and other neurodegenerative diseases; tissues for grafting such as bone marrow, skin, cartilage, tendons, bone, muscle (including cardiac muscle), blood vessels, cornea, neural cells, gastrointestinal cells and others; and organs for transplantation such as kidney, liver, pancreas (including islet cells), heart and lung.

It is contemplated that multiple different exogenous growth factors and/or cytokines may be administered in combination with the polypeptide of the invention to achieve the desired effect, including any of the growth factors listed herein, other stem cell maintenance factors, and specifically including stem cell factor (SCF), leukemia inhibitory factor (LIF), Flt-3 ligand (Flt-3L), any of the interleukins, recombinant soluble IL-6 receptor fused to IL-6, macrophage inflammatory protein 1-alpha (MIP-1-alpha), G-CSF, GM-CSF, thrombopoietin (TPO), platelet factor 4 (PF-4), platelet-derived growth factor (PDGF), neural growth factors and basic fibroblast growth factor (bFGF).

Since totipotent stem cells can give rise to virtually any mature cell type, expansion of these cells in culture will facilitate the production of large quantities of mature cells. Techniques for culturing stem cells are known in the art and administration of polypeptides of the invention, optionally with other growth factors and/or cytokines, is expected to enhance the survival and proliferation of the stem cell populations. This can be accomplished by direct administration of the polypeptide of the invention to the culture medium. Alternatively, stroma cells transfected with a polynucleotide that encodes for the polypeptide of the invention can be used as a feeder layer for the stem cell populations in culture or in vivo. Stromal support cells for feeder layers may include embryonic bone marrow fibroblasts, bone marrow stromal cells, fetal liver cells, or cultured embryonic fibroblasts (see U.S. Pat. No. 5,690,926).

Stem cells themselves can be transfected with a polynucleotide of the invention to induce autocrine expression of the polypeptide of the invention. This will allow for generation of undifferentiated totipotential/pluripotential stem cell lines that are useful as is or that can then be differentiated into the desired mature cell types. These stable cell lines can also serve as a source of undifferentiated totipotential/pluripotential mRNA to create cDNA libraries and templates for polymerase chain reaction experiments. These studies would allow for the isolation and identification of differentially expressed genes in stem cell populations that regulate stem cell proliferation and/or maintenance.

Expansion and maintenance of totipotent stem cell populations will be useful in the treatment of many pathological conditions. For example, polypeptides of the present invention may be used to manipulate stem cells in culture to give rise to neuroepithelial cells that can be used to augment or replace cells damaged by illness, autoimmune disease, accidental damage or genetic disorders. The polypeptide of the invention may be useful for inducing the proliferation of neural cells and for the regeneration of nerve and brain tissue, i.e. for the treatment of central and peripheral nervous system diseases and neuropathies, as well as mechanical and traumatic disorders which involve degeneration, death or trauma to neural cells or nerve tissue. In addition, the expanded stem cell populations can also be genetically altered for gene therapy purposes and to decrease host rejection of replacement tissues after grafting or implantation.

Expression of the polypeptide of the invention and its effect on stem cells can also be manipulated to achieve controlled differentiation of the stem cells into more differentiated cell types. A broadly applicable method of obtaining pure populations of a specific differentiated cell type from undifferentiated stem cell populations involves the use of a cell-type specific promoter driving a selectable marker. The selectable marker allows only cells of the desired type to survive. For example, stem cells can be induced to differentiate into cardiomyocytes (Wobus et al., Differentiation, 48: 173–182, (1991); Klug et al., J. Clin. Invest., 98(1): 216–224, (1998)) or skeletal muscle cells (Browder, L. W. In: *Principles of Tissue Engineering eds.* Lanza et al., Academic Press (1997)). Alternatively, directed differentiation of stem cells can be accomplished by culturing the stem cells in the presence of a differentiation factor such as retinoic acid and an antagonist of the polypeptide of the invention which would inhibit the effects of endogenous stem cell factor activity and allow differentiation to proceed.

In vitro cultures of stem cells can be used to determine if the polypeptide of the invention exhibits stem cell growth factor activity. Stem cells are isolated from any one of various cell sources (including hematopoietic stem cells and embryonic stem cells) and cultured on a feeder layer, as described by Thompson et al. Proc. Natl. Acad. Sci, U.S.A., 92: 7844–7848 (1995), in the presence of the polypeptide of the invention alone or in combination with other growth factors or cytokines. The ability of the polypeptide of the invention to induce stem cells proliferation is determined by colony formation on semi-solid support e.g. as described by Bernstein et al., Blood, 77: 2316–2321 (1991).

4.7.5 HEMATOPOIESIS REGULATING ACTIVITY

A polypeptide of the present invention may be involved in regulation of hematopoiesis and, consequently, in the treatment of myeloid or lymphoid cell disorders. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelosuppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantation, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy.

Therapeutic compositions of the invention can be used in the following:

Suitable assays for proliferation and differentiation of various hematopoietic lines are cited above.

Assays for embryonic stem cell differentiation (which will identify, among others, proteins that influence embryonic differentiation hematopoiesis) include, without limitation, those described in: Johansson et al. Cellular Biology 15:141–151, 1995; Keller et al., Molecular and Cellular Biology 13:473–486, 1993; McClanahan et al., Blood 81:2903–2915, 1993.

Assays for stem cell survival and differentiation (which will identify, among others, proteins that regulate lymphohematopoiesis) include, without limitation, those described in: Methylcellulose colony forming assays, Freshney, M. G. In Culture of Hematopoietic Cells. R. I. Freshney, et al. eds. Vol pp. 265–268, Wiley-Liss, Inc., New York, N.Y. 1994; Hirayama et al., Proc. Natl. Acad. Sci. USA 89:5907–5911, 1992; Primitive hematopoietic colony forming cells with high proliferative potential, McNiece, I. K. and Briddell, R. A. In Culture of Hematopoietic Cells. R. I. Freshney, et al. eds. Vol pp. 23–39, Wiley-Liss, Inc., New York, N.Y. 1994; Neben et al., Experimental Hematology 22:353–359, 1994; Cobblestone area forming cell assay, Ploemacher, R. E. In Culture of Hematopoietic Cells. R. I. Freshney, et al. eds. Vol pp. 1–21, Wiley-Liss, Inc., New York, N.Y. 1994; Long term bone marrow cultures in the presence of stromal cells, Spooncer, E., Dexter, M. and Allen, T. In Culture of Hematopoietic Cells. R. I. Freshney, et al. eds. Vol pp. 163–179, Wiley-Liss, Inc., New York, N.Y. 1994; Long term culture initiating cell assay, Sutherland, H. J. In Culture of Hematopoietic Cells. R. I. Freshney, et al. eds. Vol pp. 139–162, Wiley-Liss, Inc., New York, N.Y. 1994.

4.7.6 TISSUE GROWTH ACTIVITY

A polypeptide of the present invention also may be involved in bone, cartilage, tendon, ligament and/or nerve tissue growth or regeneration, as well as in wound healing and tissue repair and replacement, and in healing of burns, incisions and ulcers.

A polypeptide of the present invention which induces cartilage and/or bone growth in circumstances where bone is not normally formed, has application in the healing of bone fractures and cartilage damage or defects in humans and other animals. Compositions of a polypeptide, antibody, binding partner, or other modulator of the invention may have prophylactic use in closed as well as open fracture reduction and also in the improved fixation of artificial joints. De novo bone formation induced by an osteogenic agent contributes to the repair of congenital, trauma induced, or oncologic resection induced craniofacial defects, and also is useful in cosmetic plastic surgery.

A polypeptide of this invention may also be involved in attracting bone-forming cells, stimulating growth of bone-forming cells, or inducing differentiation of progenitors of bone-forming cells. Treatment of osteoporosis, osteoarthritis, bone degenerative disorders, or periodontal disease, such as through stimulation of bone and/or cartilage repair or by blocking inflammation or processes of tissue destruction (collagenase activity, osteoclast activity, etc.) mediated by inflammatory processes may also be possible using the composition of the invention.

Another category of tissue regeneration activity that may involve the polypeptide of the present invention is tendon/ligament formation. Induction of tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a composition of the present invention contributes to the repair of congenital, trauma induced, or other tendon or ligament defects of other origin, and is also useful in cosmetic plastic surgery for attachment or repair of tendons or ligaments. The compositions of the present invention may provide environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in vivo to effect tissue repair. The compositions of the invention may also be useful in the treatment of tendinitis, carpal tunnel syndrome and other tendon or ligament defects. The compositions may also include an appropriate matrix and/or sequestering agent as a carrier as is well known in the art.

The compositions of the present invention may also be useful for proliferation of neural cells and for regeneration of nerve and brain tissue, i.e. for the treatment of central and peripheral nervous system diseases and neuropathies, as well as mechanical and traumatic disorders, which involve degeneration, death or trauma to neural cells or nerve tissue. More specifically, a composition may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a composition of the invention.

Compositions of the invention may also be useful to promote better or faster closure of non-healing wounds, including without limitation pressure ulcers, ulcers associated with vascular insufficiency, surgical and traumatic wounds, and the like.

Compositions of the present invention may also be involved in the generation or regeneration of other tissues, such as organs (including, for example, pancreas, liver, intestine, kidney, skin, endothelium), muscle (smooth, skeletal or cardiac) and vascular (including vascular endothelium) tissue, or for promoting the growth of cells comprising such tissues. Part of the desired effects may be by inhibition or modulation of fibrotic scarring may allow normal tissue to regenerate. A polypeptide of the present invention may also exhibit angiogenic activity.

A composition of the present invention may also be useful for gut protection or regeneration and treatment of lung or liver fibrosis, reperfusion injury in various tissues, and conditions resulting from systemic cytokine damage.

A composition of the present invention may also be useful for promoting or inhibiting differentiation of tissues described above from precursor tissues or cells; or for inhibiting the growth of tissues described above.

Therapeutic compositions of the invention can be used in the following:

Assays for tissue generation activity include, without limitation, those described in: International Patent Publication No. WO95/16035 (bone, cartilage, tendon); International Patent Publication No. WO95/05846 (nerve, neuronal); International Patent Publication No. WO91/07491 (skin, endothelium).

Assays for wound healing activity include, without limitation, those described in: Winter, Epidermal Wound Healing, pps. 71–112 (Maibach, H. I. and Rovee, D. T., eds.), Year Book Medical Publishers, Inc., Chicago, as modified by Eaglstein and Mertz, J. Invest. Dermatol 71:382–84 (1978).

4.7.7 IMMUNE STIMULATING OR SUPPRESSING ACTIVITY

A polypeptide of the present invention may also exhibit immune stimulating or immune suppressing activity, including without limitation the activities for which assays are described herein. A polynucleotide of the invention can encode a polypeptide exhibiting such activities. A protein may be useful in the treatment of various immune deficiencies and disorders (including severe combined immunodeficiency (SCID)), e.g., in regulating (up or down) growth and proliferation of T and/or B lymphocytes, as well as effecting the cytolytic activity of NK cells and other cell populations. These immune deficiencies may be genetic or be caused by viral (e.g., HIV) as well as bacterial or fungal infections, or may result from autoimmune disorders. More specifically, infectious diseases causes by viral, bacterial, fungal or other infection may be treatable using a protein of the present invention, including infections by HIV, hepatitis viruses, herpes viruses, mycobacteria, Leishmania spp., malaria spp. and various fungal infections such as candidiasis. Of course, in this regard, proteins of the present invention may also be useful where a boost to the immune system generally may be desirable, i.e., in the treatment of cancer.

Autoimmune disorders which may be treated using a protein of the present invention include, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitus, myasthenia gravis, graft-versus-host disease and autoimmune inflammatory eye disease. Such a protein (or antagonists thereof, including antibodies) of the present invention may also to be useful in the treatment of allergic reactions and conditions (e.g., anaphylaxis, serum sickness, drug reactions, food allergies, insect venom allergies, mastocytosis, allergic rhinitis, hypersensitivity pneumonitis, urticaria, angioedema, eczema, atopic dermatitis, allergic contact dermatitis, erythema multiforme, Stevens-Johnson syndrome, allergic conjunctivitis, atopic keratoconjunctivitis, venereal keratoconjunctivitis, giant papillary conjunctivitis and contact allergies), such as asthma (particularly allergic asthma) or other respiratory problems. Other conditions, in which immune suppression is desired (including, for example, organ transplantation), may also be treatable using a protein (or antagonists thereof) of the present invention. The therapeutic effects of the polypeptides or antagonists thereof on allergic reactions can be evaluated by in vivo animals models such as the cumulative contact enhancement test (Lastbom et al., Toxicology 125: 59–66,1998), skin prick test (Hoffmann et al., Allergy 54: 446–54, 1999), guinea pig skin sensitization test (Vohr et al., Arch. Toxocol. 73: 501–9), and murine local lymph node assay (Kimber et al., J. Toxicol. Environ. Health 53: 563–79).

Using the proteins of the invention it may also be possible to modulate immune responses, in a number of ways. Down regulation may be in the form of inhibiting or blocking an immune response already in progress or may involve preventing the induction of an immune response. The functions of activated T cells may be inhibited by suppressing T cell responses or by inducing specific tolerance in T cells, or both. Immunosuppression of T cell responses is generally an active, non-antigen-specific, process which requires continuous exposure of the T cells to the suppressive agent. Tolerance, which involves inducing non-responsiveness or anergy in T cells, is distinguishable from immunosuppression in that it is generally antigen-specific and persists after exposure to the tolerizing agent has ceased. Operationally, tolerance can be demonstrated by the lack of a T cell response upon reexposure to specific antigen in the absence of the tolerizing agent.

Down regulating or preventing one or more antigen functions (including without limitation B lymphocyte antigen functions (such as, for example, B7)), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a therapeutic composition of the invention may prevent cytokine synthesis by immune cells, such as T cells, and thus acts as an immunosuppressant. Moreover, a lack of costimulation may also be sufficient to anergize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular therapeutic compositions in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA4Ig fusion proteins in vivo as described in Lenschow et al., Science 257:789–792 (1992) and Turka et al., Proc. Natl. Acad. Sci USA, 89:11102–11105 (1992). In addition, murine models of GVHD (see Paul ed., Fundamental Immunology, Raven Press, New York, 1989, pp.846–847) can be used to determine the effect of therapeutic compositions of the invention on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block stimulation of T cells can be used to inhibit T cell activation and prevent production of autoantibodies or T cell-derived cytokines which may be involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/lpr/lpr mice or NZB hybrid mice, murine autoimmune collagen arthritis, diabetes mellitus in NOD mice and BB rats, and murine experimental myasthenia gravis (see Paul ed., Fundamental Immunology, Raven Press, New York, 1989, pp. 840–856).

Upregulation of an antigen function (e.g., a B lymphocyte antigen function), as a means of up regulating immune responses, may also be useful in therapy. Upregulation of immune responses may be in the form of enhancing an existing immune response or eliciting an initial immune response. For example, enhancing an immune response may be useful in cases of viral infection, including systemic viral diseases such as influenza, the common cold, and encephalitis.

Alternatively, anti-viral immune responses may be enhanced in an infected patient by removing T cells from the patient, costimulating the T cells in vitro with viral antigen-pulsed APCs either expressing a peptide of the present invention or together with a stimulatory form of a soluble peptide of the present invention and reintroducing the in vitro activated T cells into the patient. Another method of enhancing anti-viral immune responses would be to isolate infected cells from a patient, transfect them with a nucleic acid encoding a protein of the present invention as described herein such that the cells express all or a portion of the protein on their surface, and reintroduce the transfected cells into the patient. The infected cells would now be capable of delivering a costimulatory signal to, and thereby activate, T cells in vivo.

A polypeptide of the present invention may provide the necessary stimulation signal to T cells to induce a T cell mediated immune response against the transfected tumor cells. In addition, tumor cells which lack MHC class I or MHC class II molecules, or which fail to reexpress sufficient mounts of MHC class I or MHC class II molecules, can be transfected with nucleic acid encoding all or a portion of (e.g., a cytoplasmic-domain truncated portion) of an MHC class I alpha chain protein and p2 microglobulin protein or an MHC class II alpha chain protein and an MHC class 11 beta chain protein to thereby express MHC class I or MHC class II proteins on the cell surface. Expression of the appropriate class I or class II MHC in conjunction with a peptide having the activity of a B lymphocyte antigen (e.g., B7-1, B7-2, B7-3) induces a T cell mediated immune response against the transfected tumor cell. Optionally, a gene encoding an antisense construct which blocks expression of an MHC class II associated protein, such as the invariant chain, can also be cotransfected with a DNA encoding a peptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject.

The activity of a protein of the invention may, among other means, be measured by the following methods:

Suitable assays for thymocyte or splenocyte cytotoxicity include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Herrmann et al., Proc. Natl. Acad. Sci. USA 78:2488–2492, 1981; Herrmann et al., J. Immunol. 128:1968–1974, 1982; Handa et al., J. Immunol. 135:1564–1572, 1985; Takai et al., I. Immunol. 137:3494–3500, 1986; Takai et al., J. Immunol. 140:508–512, 1988; Bowman et al., J. Virology 61:1992–1998; Bertagnolli et al., Cellular Immunology 133:327–341, 1991; Brown et al., J. Immunol. 153:3079–3092, 1994.

Assays for T-cell-dependent immunoglobulin responses and isotype switching (which will identify, among others, proteins that modulate T-cell dependent antibody responses and that affect Th1/Th2 profiles) include, without limitation, those described in: Maliszewski, J. Immunol. 144:3028–3033, 1990; and Assays for B cell function: In vitro antibody production, Mond, J. J. and Brunswick, M. In Current Protocols in Immunology. J. E. e.a. Coligan eds. Vol 1 pp. 3.8.1–3.8.16, John Wiley and Sons, Toronto. 1994.

Mixed lymphocyte reaction (MLR) assays (which will identify, among others, proteins that generate predominantly Th1 and CTL responses) include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Takai et al., J. Immunol. 137:3494–3500, 1986; Takai et al., J. Immunol. 140:508–512, 1988; Bertagnolli et al., J. Immunol. 149:3778–3783, 1992.

Dendritic cell-dependent assays (which will identify, among others, proteins expressed by dendritic cells that activate naive T-cells) include, without limitation, those described in: Guery et al., J. Immunol. 134:536–544, 1995; Inaba et al., Journal of Experimental Medicine 173:549–559, 1991; Macatonia et al., Journal of Immunology 154:5071–5079, 1995; Porgador et al., Journal of Experimental Medicine 182:255–260, 1995; Nair et al., Journal of Virology 67:4062–4069, 1993; Huang et al., Science 264:961–965, 1994; Macatonia et al., Journal of Experimental Medicine 169:1255–1264, 1989; Bhardwaj et al., Journal of Clinical Investigation 94:797–807, 1994; and Inaba et al., Journal of Experimental Medicine 172:631–640, 1990.

Assays for lymphocyte survival/apoptosis (which will identify, among others, proteins that prevent apoptosis after superantigen induction and proteins that regulate lymphocyte homeostasis) include, without limitation, those described in: Darzynkiewicz et al., Cytometry 13:795–808, 1992; Gorczyca et al., Leukemia 7:659–670, 1993; Gorczyca et al., Cancer Research 53:1945–1951, 1993; Itoh et al., Cell 66:233–243, 1991; Zacharchuk, Journal of Immunology 145:4037–4045, 1990; Zamai et al., Cytometry 14:891–897, 1993; Gorczyca et al., International Journal of Oncology 1:639–648, 1992.

Assays for proteins that influence early steps of T-cell commitment and development include, without limitation, those described in: Antica et al., Blood 84:111–117, 1994; Fine et al., Cellular Immunology 155:111–122, 1994; Galy et al., Blood 85:2770–2778, 1995; Toki et al., Proc. Nat. Acad Sci. USA 88:7548–7551, 1991.

4.7.8 ACTIVIN/INHIBIN ACTIVITY

A polypeptide of the present invention may also exhibit activin- or inhibin-related activities. A polynucleotide of the invention may encode a polypeptide exhibiting such characteristics. Inhibins are characterized by their ability to inhibit the release of follicle stimulating hormone (FSH), while activins and are characterized by their ability to stimulate the release of follicle stimulating hormone (FSH). Thus, a polypeptide of the present invention, alone or in heterodimers with a member of the inhibin family, may be useful as a contraceptive based on the ability of inhibins to decrease fertility in female mammals and decrease spermatogenesis in male mammals. Administration of sufficient amounts of other inhibins can induce infertility in these mammals. Alternatively, the polypeptide of the invention, as a homodimer or as a heterodimer with other protein subunits of the inhibin group, may be useful as a fertility inducing therapeutic, based upon the ability of activin molecules in stimulating FSH release from cells of the anterior pituitary. See, for example, U.S. Pat. No. 4,798,885. A polypeptide of the invention may also be useful for advancement of the onset of fertility in sexually immature mammals, so as to increase the lifetime reproductive performance of domestic animals such as, but not limited to, cows, sheep and pigs.

The activity of a polypeptide of the invention may, among other means, be measured by the following methods.

Assays for activin/inhibin activity include, without limitation, those described in: Vale et al., Endocrinology 91:562–572, 1972; Ling et al., Nature 321:779–782, 1986; Vale et al., Nature 321:776–779, 1986; Mason et al., Nature 318:659–663, 1985; Forage et al., Proc. Natl. Acad. Sci. USA 83:3091–3095, 1986.

4.7.9 CHEMOTACTIC/CHEMOKINETIC ACTIVITY

A polypeptide of the present invention may be involved in chemotactic or chemokinetic activity for mammalian cells, including, for example, monocytes, fibroblasts, neutrophils, T-cells, mast cells, eosinophils, epithelial and/or endothelial cells. A polynucleotide of the invention can encode a polypeptide exhibiting such attributes. Chemotactic and chemokinetic receptor activation can be used to mobilize or attract a desired cell population to a desired site of action. Chemotactic or chemokinetic compositions (e.g. proteins, antibodies, binding partners, or modulators of the invention) provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or peptide has chemotactic activity for a particular cell population if it can stimulate, directly or indirectly, the directed orientation or movement of such cell population. Preferably, the protein or peptide has the ability to directly stimulate directed movement of cells. Whether a particular protein has chemotactic activity for a population of cells can be readily determined by employing such protein or peptide in any known assay for cell chemotaxis.

Therapeutic compositions of the invention can be used in the following:

Assays for chemotactic activity (which will identify proteins that induce or prevent chemotaxis) consist of assays that measure the ability of a protein to induce the migration of cells across a membrane as well as the ability of a protein to induce the adhesion of one cell population to another cell population. Suitable assays for movement and adhesion include, without limitation, those described in: Current Protocols in Immunology, Ed by J. E. Coligan, A. M. Kruisbeek, D. H. Marguiles, E. M. Shevach, W. Strober, Pub. Greene Publishing Associates and Wiley-Interscience (Chapter 6.12, Measurement of alpha and beta Chemokines 6.12.1–6.12.28; Taub et al. J. Clin. Invest. 95:1370–1376, 1995; Lind et al. APMIS 103:140–146, 1995; Muller et al Eur. J. Immunol. 25:1744–1748; Gruber et al. J. of Immunol. 152:5860–5867, 1994; Johnston et al. J. of Immunol. 153:1762–1768, 1994.

4.7.10 HEMOSTATIC AND THROMBOLYTIC ACTIVITY

A polypeptide of the invention may also be involved in hemostatis or thrombolysis or thrombosis. A polynucleotide of the invention can encode a polypeptide exhibiting such attributes. Compositions may be useful in treatment of various coagulation disorders (including hereditary disorders, such as hemophilias) or to enhance coagulation and other hemostatic events in treating wounds resulting from trauma, surgery or other causes. A composition of the invention may also be useful for dissolving or inhibiting formation of thromboses and for treatment and prevention of conditions resulting therefrom (such as, for example, infarction of cardiac and central nervous system vessels (e.g., stroke).

Therapeutic compositions of the invention can be used in the following:

Assay for hemostatic and thrombolytic activity include, without limitation, those described in: Linet et al., J. Clin. Pharmacol. 26:131–140, 1986; Burdick et al., Thrombosis Res. 45:413–419, 1987; Humphrey et al., Fibrinolysis 5:71–79 (1991); Schaub, Prostaglandins 35:467–474, 1988.

4.7.11 CANCER DIAGNOSIS AND THERAPY

Polypeptides of the invention may be involved in cancer cell generation, proliferation or metastasis. Detection of the presence or amount of polynucleotides or polypeptides of the invention may be useful for the diagnosis and/or prognosis of one or more types of cancer. For example, the presence or increased expression of a polynucleotide/polypeptide of the invention may indicate a hereditary risk of cancer, a precancerous condition, or an ongoing malignancy. Conversely, a defect in the gene or absence of the polypeptide may be associated with a cancer condition. Identification of single nucleotide polymorphisms associated with cancer or a predisposition to cancer may also be useful for diagnosis or prognosis.

Cancer treatments promote tumor regression by inhibiting tumor cell proliferation, inhibiting angiogenesis (growth of new blood vessels that is necessary to support tumor growth) and/or prohibiting metastasis by reducing tumor cell motility or invasiveness. Therapeutic compositions of the invention may be effective in adult and pediatric oncology including in solid phase tumors/malignancies, locally advanced tumors, human soft tissue sarcomas, metastatic cancer, including lymphatic metastases, blood cell malignancies including multiple myeloma, acute and chronic leukemias, and lymphomas, head and neck cancers including mouth cancer, larynx cancer and thyroid cancer, lung cancers including small cell carcinoma and non-small cell cancers, breast cancers including small cell carcinoma and ductal carcinoma, gastrointestinal cancers including esophageal cancer, stomach cancer, colon cancer, colorectal cancer and polyps associated with colorectal neoplasia, pancreatic cancers, liver cancer, urologic cancers including bladder cancer and prostate cancer, malignancies of the female genital tract including ovarian carcinoma, uterine (including endometrial) cancers, and solid tumor in the ovarian follicle, kidney cancers including renal cell carcinoma, brain cancers including intrinsic brain tumors, neuroblastoma, astrocytic brain tumors, gliomas, metastatic tumor cell invasion in the central nervous system, bone cancers including osteomas, skin cancers including malignant melanoma, tumor progression of human skin keratinocytes, squamous cell carcinoma, basal cell carcinoma, hemangiopericytoma and Karposi's sarcoma.

Polypeptides, polynucleotides, or modulators of polypeptides of the invention (including inhibitors and stimulators of the biological activity of the polypeptide of the invention) may be administered to treat cancer. Therapeutic compositions can be administered in therapeutically effective dosages alone or in combination with adjuvant cancer therapy such as surgery, chemotherapy, radiotherapy, thermotherapy, and laser therapy, and may provide a beneficial effect, e.g. reducing tumor size, slowing rate of tumor growth, inhibiting metastasis, or otherwise improving overall clinical condition, without necessarily eradicating the cancer.

The composition can also be administered in therapeutically effective amounts as a portion of an anti-cancer cocktail. An anti-cancer cocktail is a mixture of the polypeptide or modulator of the invention with one or more anti-cancer drugs in addition to a pharmaceutically acceptable carrier for delivery. The use of anti-cancer cocktails as a cancer treatment is routine. Anti-cancer drugs that are well known in the art and can be used as a treatment in combination with the polypeptide or modulator of the invention include: Actinomycin D, Aminoglutethimide, Asparaginase, Bleomycin, Busulfan, Carboplatin, Carmustine, Chlorambucil, Cisplatin (cis-DDP), Cyclophosphamide, Cytarabine HCl (Cytosine arabinoside), Dacarbazine, Dactinomycin, Daunorubicin HCl, Doxorubicin HCl, Estramustine phosphate sodium, Etoposide (V16–213), Floxuridine, 5-Fluorouracil (5-Fu), Flutamide, Hydroxyurea (hydroxycarbamide), Ifosfamide, Interferon Alpha-2a, Interferon Alpha-2b, Leuprolide acetate (LHRH-releasing factor analog), Lomustine, Mechlorethamine HCl (nitrogen mustard), Melphalan, Mercaptopurine, Mesna, Methotrexate (MTX), Mitomycin, Mitoxantrone HCl, Octreotide, Plicamycin, Procarbazine HCl, Streptozocin, Tamoxifen citrate, Thioguanine, Thiotepa, Vinblastine sulfate, Vincristine sulfate, Amsacrine, Azacitidine, Hexamethylmelamine, Interleukin-2, Mitoguazone, Pentostatin, Semustine, Teniposide, and Vindesine sulfate.

In addition, therapeutic compositions of the invention may be used for prophylactic treatment of cancer. There are hereditary conditions and/or environmental situations (e.g. exposure to carcinogens) known in the art that predispose an individual to developing cancers. Under these circumstances, it may be beneficial to treat these individuals with therapeutically effective doses of the polypeptide of the invention to reduce the risk of developing cancers.

In vitro models can be used to determine the effective doses of the polypeptide of the invention as a potential cancer treatment. These in vitro models include proliferation assays of cultured tumor cells, growth of cultured tumor cells in soft agar (see Freshney, (1987) Culture of Animal Cells: A Manual of Basic Technique, Wily-Liss, New York, N.Y. Ch 18 and Ch 21), tumor systems in nude mice as described in Giovanella et al., J. Natl. Can. Inst., 52: 921–30 (1974), mobility and invasive potential of tumor cells in Boyden Chamber assays as described in Pilkington et al., Anticancer Res., 17: 4107–9 (1997), and angiogenesis assays such as induction of vascularization of the chick chorioallantoic membrane or induction of vascular endothelial cell migration as described in Ribatta et al., Intl. J. Dev. Biol., 40: 1189–97 (1999) and Li et al., Clin. Exp. Metastasis, 17:423–9 (1999), respectively. Suitable tumor cells lines are available, e.g. from American Type Tissue Culture Collection catalogs.

4.7.12 RECEPTOR/LIGAND ACTIVITY

A polypeptide of the present invention may also demonstrate activity as receptor, receptor ligand or inhibitor or agonist of receptor/ligand interactions. A polynucleotide of the invention can encode a polypeptide exhibiting such characteristics. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selectins, integrins and their ligands) and receptor/ligand pairs involved in antigen presentation, antigen recognition and development of cellular and humoral immune responses. Receptors and ligands are also useful for screening of potential peptide or small molecule inhibitors of the relevant receptor/ligand interaction. A protein of the present invention (including, without limitation, fragments of receptors and ligands) may themselves be useful as inhibitors of receptor/ligand interactions.

The activity of a polypeptide of the invention may, among other means, be measured by the following methods:

Suitable assays for receptor-ligand activity include without limitation those described in: Current Protocols in Immunology, Ed by J. E. Coligan, A. M. Kruisbeek, D. H. Margulies, E. M. Shevach, W. Strober, Pub. Greene Publishing Associates and Wiley- Interscience (Chapter 7.28, Measurement of Cellular Adhesion under static conditions 7.28.1–7.28.22), Takai et al., Proc. Nati. Acad. Sci. USA 84:6864–6868, 1987; Bierer et al., J. Exp. Med. 168:1145–1156, 1988; Rosenstein et al., J. Exp. Med. 169:149–160 1989; Stoltenborg et al., J. Immunol. Methods 175:59–68, 1994; Stitt et al., Cell 80:661–670, 1995.

By way of example, the polypeptides of the invention may be used as a receptor for a ligand(s) thereby transmitting the biological activity of that ligand(s). Ligands may be identified through binding assays, affinity chromatography, dihybrid screening assays, BIAcore assays, gel overlay assays, or other methods known in the art.

Studies characterizing drugs or proteins as agonist or antagonist or partial agonists or a partial antagonist require the use of other proteins as competing ligands. The polypeptides of the present invention or ligand(s) thereof may be labeled by being coupled to radioisotopes, colorimetric molecules or a toxin molecules by conventional methods. ("Guide to Protein Purification" Murray P. Deutscher (ed) Methods in Enzymology Vol. 182 (1990) Academic Press, Inc. San Diego). Examples of radioisotopes include, but are not limited to, tritium and carbon-14. Examples of colorimetric molecules include, but are not limited to, fluorescent molecules such as fluorescamine, or rhodamine or other colorimetric molecules. Examples of toxins include, but are not limited, to ricin.

4.7.13 DRUG SCREENING

This invention is particularly useful for screening chemical compounds by using the novel polypeptides or binding fragments thereof in any of a variety of drug screening techniques. The polypeptides or fragments employed in such a test may either be free in solution,. affixed to a solid support, borne on a cell surface or located intracellularly. One method of drug screening utilizes eukaryotic or prokaryotic host cells which are stably transformed with recombinant nucleic acids expressing the polypeptide or a fragment thereof. Drugs are screened against such transformed cells in competitive binding assays. Such cells, either in viable or fixed form, can be used for standard binding assays. One may measure, for example, the formation of complexes between polypeptides of the invention or fragments and the agent being tested or examine the diminution in complex formation between the novel polypeptides and an appropriate cell line, which are well known in the art.

Sources for test compounds that may be screened for ability to bind to or modulate (i.e., increase or decrease) the activity of polypeptides of the invention include (1) inorganic and organic chemical libraries, (2) natural product libraries, and (3) combinatorial libraries comprised of either random or mimetic peptides, oligonucleotides or organic molecules.

Chemical libraries may be readily synthesized or purchased from a number of commercial sources, and may include structural analogs of known compounds or compounds that are identified as "hits" or "leads" via natural product screening.

The sources of natural product libraries are microorganisms (including bacteria and fungi), animals, plants or other vegetation, or marine organisms, and libraries of mixtures for screening may be created by: (1) fermentation and extraction of broths from soil, plant or marine microorganisms or (2) extraction of the organisms themselves. Natural product libraries include polyketides, non-ribosomal peptides, and (non-naturally occurring) variants thereof. For a review, see Science 282:63–68 (1998).

Combinatorial libraries are composed of large numbers of peptides, oligonucleotides or organic compounds and can be readily prepared by traditional automated synthesis methods, PCR, cloning or proprietary synthetic methods. Of particular interest are peptide and oligonucleotide combinatorial libraries. Still other libraries of interest include peptide, protein, peptidomimetic, multiparallel synthetic collection, recombinatorial, and polypeptide libraries. For a review of combinatorial chemistry and libraries created therefrom, see Myers, *Curr. Opin. Biotechnol.* 8:701–707 (1997). For reviews and examples of peptidomimetic libraries, see Al-Obeidi et al., *Mol. Biotechnol*, 9(3):205–23 (1998); Hruby et al., *Curr Opin Chem Biol*, 1(1): 114–19 (1997); Dorner et al., *Bioorg Med Chem*, 4(5):709–15 (1996) (alkylated dipeptides).

Identification of modulators through use of the various libraries described herein permits modification of the candidate "hit" (or "lead") to optimize the capacity of the "hit" to bind a polypeptide of the invention. The molecules identified in the binding assay are then tested for antagonist or agonist activity in in vivo tissue culture or animal models that are well known in the art. In brief, the molecules are titrated into a plurality of cell cultures or animals and then tested for either cell/animal death or prolonged survival of the animal/cells.

The binding molecules thus identified may be complexed with toxins, e.g., ricin or cholera, or with other compounds that are toxic to cells such as radioisotopes. The toxin-binding molecule complex is then targeted to a tumor or other cell by the specificity of the binding molecule for a polypeptide of the invention. Alternatively, the binding molecules may be complexed with imaging agents for targeting and imaging purposes.

4.7.14 ASSAY FOR RECEPTOR ACTIVITY

The invention also provides methods to detect specific binding of a polypeptide e.g. a ligand or a receptor. The art provides numerous assays particularly useful for identifying previously unknown binding partners for receptor polypeptides of the invention. For example, expression cloning using mammalian or bacterial cells, or dihybrid screening assays can be used to identify polynucleotides encoding binding partners. As another example, affinity chromatography with the appropriate immobilized polypeptide of the invention can be used to isolate polypeptides that recognize and bind polypeptides of the invention. There are a number of different libraries used for the identification of compounds, and in particular small molecules, that modulate (i.e., increase or decrease) biological activity of a polypeptide of the invention. Ligands for receptor polypeptides of the invention can also be identified by adding exogenous ligands, or cocktails of ligands to two cells populations that are genetically identical except for the expression of the receptor of the invention: one cell population expresses the receptor of the invention whereas the other does not. The response of the two cell populations to the addition of ligands(s) are then compared. Alternatively, an expression library can be co-expressed with the polypeptide of the invention in cells and assayed for an autocrine response to identify potential ligand(s). As still another example, BIAcore assays, gel overlay assays, or other methods known in the art can be used to identify binding partner polypeptides, including, (1) organic and inorganic chemical libraries, (2) natural product libraries, and (3) combinatorial libraries comprised of random peptides, oligonucleotides or organic molecules.

The role of downstream intracellular signaling molecules in the signaling cascade of the polypeptide of the invention can be determined. For example, a chimeric protein in which the cytoplasmic domain of the polypeptide of the invention is fused to the extracellular portion of a protein, whose ligand has been identified, is produced in a host cell. The cell is then incubated with the ligand specific for the extracellular portion of the chimeric protein, thereby activating the chimeric receptor. Known downstream proteins involved in intracellular signaling can then be assayed for expected modifications i.e. phosphorylation. Other methods known to those in the art can also be used to identify signaling molecules involved in receptor activity.

4.7.15 ANTI-INFLAMMATORY ACTIVITY

Compositions of the present invention may also exhibit anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Compositions with such activities can be used to treat inflammatory conditions including chronic or acute conditions), including without limitation intimation associated with infection (such as septic shock, sepsis or systemic inflammatory response syndrome (SIRS)), ischemia-reperfusion injury, endotoxin lethality, arthritis, complement-mediated hyperacute rejection, nephritis, cytokine or chemokine-induced lung injury, inflammatory bowel disease, Crohn's disease or resulting from over production of cytokines such as TNF or IL-1. Compositions of the invention may also be useful to treat anaphylaxis and hypersensitivity to an antigenic substance or material. Compositions of this invention may be utilized to prevent or treat conditions such as, but not limited to, sepsis, acute pancreatitis, endotoxin shock, cytokine induced shock, rheumatoid arthritis, chronic inflammatory arthritis, pancreatic cell damage from diabetes mellitus type 1, graft versus host disease, inflammatory bowel disease, inflamation associated with pulmonary disease, other autoimmune disease or inflammatory disease, an antiproliferative agent such as for acute or chronic mylegenous leukemia or in the prevention of premature labor secondary to intrauterine infections.

4.7.16 LEUKEMIAS

Leukemias and related disorders may be treated or prevented by administration of a therapeutic that promotes or inhibits function of the polynucleotides and/or polypeptides of the invention. Such leukemias and related disorders include but are not limited to acute leukemia, acute lymphocytic leukemia, acute myelocytic leukemia, myeloblastic, promyelocytic, myelomonocytic, monocytic, erythroleukemia, chronic leukemia, chronic myelocytic (granulocytic) leukemia and chronic lymphocytic leukemia (for a review of such disorders, see Fishman et al., 1985, Medicine, 2d Ed., J.B. Lippincott Co., Philadelphia).

4.7.17 NERVOUS SYSTEM DISORDERS

Nervous system disorders, involving cell types which can be tested for efficacy of intervention with compounds that modulate the activity of the polynucleotides and/or polypeptides of the invention, and which can be treated upon thus observing an indication of therapeutic utility, include but are not limited to nervous system injuries, and diseases or disorders which result in either a disconnection of axons, a diminution or degeneration of neurons, or demyelination. Nervous system lesions which may be treated in a patient (including human and non-human mammalian patients) according to the invention include but are not limited to the following lesions of either the central (including spinal cord, brain) or peripheral nervous systems:

(i) traumatic lesions, including lesions caused by physical injury or associated with surgery, for example, lesions which sever a portion of the nervous system, or compression injuries;

(ii) ischemic lesions, in which a lack of oxygen in a portion of the nervous system results in neuronal injury or death, including cerebral infarction or ischemia, or spinal cord infarction or ischemia;

(iii) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, syphilis;

(iv) degenerative lesions, in which a portion of the nervous system is destroyed or injured as a result of a degenerative process including but not limited to degeneration associated with Parkinson's disease, Alzheimer's disease, Huntington's chorea, or amyotrophic lateral sclerosis;

(v) lesions associated with nutritional diseases or disorders, in which a portion of the nervous system is destroyed or injured by a nutritional disorder or disorder of metabolism including but not limited to, vitamin B12 deficiency, folic acid deficiency, Wernicke disease, tobacco-alcohol amblyopia, Marchiafava-Bignami disease (primary degeneration of the corpus callosum), and alcoholic cerebellar degeneration;

(vi) neurological lesions associated with systemic diseases including but not limited to diabetes (diabetic neuropathy, Bell's palsy), systemic lupus erythematosus, carcinoma, or sarcoidosis;

(vii) lesions caused by toxic substances including alcohol, lead, or particular neurotoxins; and (viii) demyelinated lesions in which a portion of the nervous system is destroyed or injured by a demyelinating disease including but not limited to multiple sclerosis, human immunodeficiency virus-associated myelopathy, transverse myelopathy or various etiologies, progressive multifocal leukoencephalopathy, and central pontine myelinolysis.

Therapeutics which are useful according to the invention for treatment of a nervous system disorder may be selected by testing for biological activity in promoting the survival or differentiation of neurons. For example, and not by way of limitation, therapeutics which elicit any of the following effects may be useful according to the invention:

(i) increased survival time of neurons in culture;

(ii) increased sprouting of neurons in culture or in vivo;

(iii) increased production of a neuron-associated molecule in culture or in vivo, e.g., choline acetyltransferase or acetylcholinesterase with respect to motor neurons; or (iv) decreased symptoms of neuron dysfunction in vivo.

Such effects may be measured by any method known in the art. In preferred, non-limiting embodiments, increased survival of neurons may be measured by the method set forth in Arakawa et al. (1990, J. Neurosci. 10:3507–3515); increased sprouting of neurons may be detected by methods set forth in Pestronk et al. (1980, Exp. Neurol. 70:65–82) or Brown et al. (1981, Ann. Rev. Neurosci. 4:17–42); increased production of neuron-associated molecules may be measured by bioassay, enzymatic assay, antibody binding, Northern blot assay, etc., depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include but are not limited to disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including but not limited to progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

4.7.18 OTHER ACTIVITIES

A polypeptide of the invention may also exhibit one or more of the following additional activities or effects: inhibiting the growth, infection or function of, or killing, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, co-factors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); inimunoglobulin-like activity (such as, for example, the ability to bind antigens or complement); and the ability to act as an antigen in a vaccine composition to raise an immune response against such protein or another material or entity which is cross-reactive with such protein.

4.7.19 IDENTIFICATION OF POLYMORPHISMS

The demonstration of polymorphisms makes possible the identification of such polymorphisms in human subjects and the pharmacogenetic use of this information for diagnosis and treatment. Such polymorphisms may be associated with, e.g., differential predisposition or susceptibility to various disease states (such as disorders involving inflammation or immune response) or a differential response to drug administration, and this genetic information can be used to tailor preventive or therapeutic treatment appropriately. For example, the existence of a polymorphism associated with a predisposition to inflammation or autoimmune disease makes possible the diagnosis of this condition in humans by identifying the presence of the polymorphism.

Polymorphisms can be identified in a variety of ways known in the art which all generally involve obtaining a sample from a patient, analyzing DNA from the sample, optionally involving isolation or amplification of the DNA, and identifying the presence of the polymorphism in the DNA. For example, PCR may be used to amplify an appropriate fragment of genomic DNA which may then be sequenced. Alternatively, the DNA may be subjected to allele-specific oligonucleotide hybridization (in which appropriate oligonucleotides are hybridized to the DNA under conditions permitting detection of a single base mismatch) or to a single nucleotide extension assay (in which an oligonucleotide that hybridizes immediately adjacent to the position of the polymorphism is extended with one or more labeled nucleotides). In addition, traditional restriction fragment length polymorphism analysis (using restriction enzymes that provide differential digestion of the genomic DNA depending on the presence or absence of the polymorphism) may be performed. Arrays with nucleotide sequences of the present invention can be used to detect polymorphisms. The array can comprise modified nucleotide sequences of the present invention in order to detect the nucleotide sequences of the present invention. In the alternative, any one of the nucleotide sequences of the present invention can be placed on the array to detect changes from those sequences.

Alternatively a polymorphism resulting in a change in the amino acid sequence could also be detected by detecting a corresponding change in amino acid sequence of the protein, e.g., by an antibody specific to the variant sequence.

4.7.20 ARTHRITIS AND INFLAMMATION

The immunosuppressive effects of the compositions of the invention against rheumatoid arthritis is determined in an experimental animal model system. The experimental model system is adjuvant induced arthritis in rats, and the protocol is described by J. Holoshitz, et at., 1983, Science, 219:56, or by B. Waksman et al., 1963, Int. Arch. Allergy Appl. Immunol., 23:129. Induction of the disease can be caused by a single injection, generally intradermally, of a suspension of killed Mycobacterium tuberculosis in complete Freund's adjuvant (CFA). The route of injection can vary, but rats may be injected at the base of the tail with an adjuvant mixture. The polypeptide is administered in phosphate buffered solution (PBS) at a dose of about 1–5 mg/kg. The control consists of administering PBS only.

The procedure for testing the effects of the test compound would consist of intradermally injecting killed Mycobacterium tuberculosis in CFA followed by immediately administering the test compound and subsequent treatment every other day until day 24. At 14, 15, 18, 20, 22, and 24 days after injection of Mycobacterium CFA, an overall arthritis score may be obtained as described by J. Holoskitz above. An analysis of the data would reveal that the test compound would have a dramatic affect on the swelling of the joints as measured by a decrease of the arthritis score.

4.8 THERAPEUTIC METHODS

The compositions (including polypeptide fragments, analogs, variants and antibodies or other binding partners or modulators including antisense polynucleotides) of the invention have numerous applications in a variety of therapeutic methods. Examples of therapeutic applications include, but are not limited to, those exemplified herein.

4.8.1 EXAMPLE

One embodiment of the invention is the administration of an effective amount of the polypeptides or other composition of the invention to individuals affected by a disease or disorder that can be modulated by regulating the peptides of the invention. While the mode of administration is not particularly important, parenteral administration is preferred. An exemplary mode of administration is to deliver an intravenous bolus. The dosage of the polypeptides or other composition of the invention will normally be determined by the prescribing physician. It is to be expected that the dosage will vary according to the age, weight, condition and response of the individual patient. Typically, the amount of polypeptide administered per dose will be in the range of about 0.01 $\mu$g/kg to 100 mg/kg of body weight, with the preferred dose being about 0.1 $\mu$g/kg to 10 mg/kg of patient body weight. For parenteral administration, polypeptides of the invention will be formulated in an injectable form combined with a pharmaceutically acceptable parenteral vehicle. Such vehicles are well known in the art and examples include water, saline, Ringer's solution, dextrose solution, and solutions consisting of small amounts of the human serum albumin. The vehicle may contain minor amounts of additives that maintain the isotonicity and stability of the polypeptide or other active ingredient. The preparation of such solutions is within the skill of the art.

4.9 PHARMACEUTICAL FORMULATIONS AND ROUTES OF ADMINISTRATION

A protein or other composition of the present invention (from whatever source derived, including without limitation from recombinant and non-recombinant sources and including antibodies and other binding partners of the polypeptides of the invention) may be administered to a patient in need, by itself, or in pharmaceutical compositions where it is mixed with suitable carriers or excipient(s) at doses to treat or ameliorate a variety of disorders. Such a composition may optionally contain (in addition to protein or other active ingredient and a carrier) diluents, fillers, salts, buffers, stabilizers, solubilizers, and other materials well known in the art. The term "pharmaceutically acceptable" means a non-toxic material that does not interfere with the effectiveness of the biological activity of the active ingredient(s). The characteristics of the carrier will depend on the route of administration. The pharmaceutical composition of the invention may also contain cytokines, lymphokines, or other hematopoietic factors such as M-CSF, GM-CSF, TNF, IL-1, IL-2, IL-3, IL-4, IL-5, IL-6, IL-7, IL-8, IL-9, IL-10, IL-11, IL-12, IL-13, IL-14, IL-15, IFN, TNF0, TNF1, TNF2, G-CSF, Meg-CSF, thrombopoietin, stem cell factor, and erythropoietin. In further compositions, proteins of the invention may be combined with other agents beneficial to the treatment of the disease or disorder in question. These agents include various growth factors such as epidermal growth factor (EGF), platelet-derived growth factor (PDGF), transforming growth factors (TGF-α and TGF-β), insulin-like growth factor (IGF), as well as cytokines described herein.

The pharmaceutical composition may further contain other agents which either enhance the activity of the protein or other active ingredient or complement its activity or use in treatment. Such additional factors and/or agents may be included in the pharmaceutical composition to produce a synergistic effect with protein or other active ingredient of the invention, or to minimize side effects. Conversely, protein or other active ingredient of the present invention may be included in formulations of the particular clotting factor, cytokine, lymphokine, other hematopoietic factor, thrombolytic or anti-thrombotic factor, or anti- inflammatory agent to minimize side effects of the clotting factor, cytokine, lymphokine, other hematopoietic factor, thrombolytic or anti-thrombotic factor, or anti-inflammatory agent (such as IL-IRa, IL-1 Hy1, IL-1 Hy2, anti-TNF, corticosteroids, immunosuppressive agents). A protein of the present invention may be active in multimers (e.g., heterodimers or homodimers) or complexes with itself or other proteins. As a result, pharmaceutical compositions of the invention may comprise a protein of the invention in such multimeric or complexed form.

As an alternative to being included in a pharmaceutical composition of the invention including a first protein, a second protein or a therapeutic agent may be concurrently administered with the first protein (e.g., at the same time, or at differing times provided that therapeutic concentrations of the combination of agents is achieved at the treatment site). Techniques for formulation and administration of the compounds of the instant application may be found in "Remington's Pharmaceutical Sciences," Mack Publishing Co., Easton, Pa., latest edition. A therapeutically effective dose further refers to that amount of the compound sufficient to result in amelioration of symptoms, e.g., treatment, healing, prevention or amelioration of the relevant medical condition, or an increase in rate of treatment, healing, prevention or amelioration of such conditions. When applied to an individual active ingredient, administered alone, a therapeutically effective dose refers to that ingredient alone. When applied to a combination, a therapeutically effective dose refers to combined amounts of the active ingredients that result in the therapeutic effect, whether administered in combination, serially or simultaneously.

In practicing the method of treatment or use of the present invention, a therapeutically effective amount of protein or other active ingredient of the present invention is administered to a mammal having a condition to be treated. Protein or other active ingredient of the present invention may be administered in accordance with the method of the invention either alone or in combination with other therapies such as treatments employing cytokines, lymphokines or other hematopoietic factors. When co-administered with one or more cytokines, lymphokines or other hematopoietic factors, protein or other active ingredient of the present invention may be administered either simultaneously with the cytokine(s), lymphokine(s), other hematopoietic factor (s), thrombolytic or anti-thrombotic factors, or sequentially. If administered sequentially, the attending physician will decide on the appropriate sequence of administering protein or other active ingredient of the present invention in combination with cytokine(s), lymphokine(s), other hematopoietic factor(s), thrombolytic or anti-thrombotic factors.

4.9.1 ROUTES OF ADMINISTRATION

Suitable routes of administration may, for example, include oral, rectal, transmucosal, or intestinal administration; parenteral delivery, including intramuscular, subcutaneous, intramedullary injections, as well as intrathecal, direct intraventricular, intravenous, intraperitoneal, intranasal, or intraocular injections. Administration of protein or other active ingredient of the present invention used in the pharmaceutical composition or to practice the method of the present invention can be carried out in a variety of conventional ways, such as oral ingestion, inhalation, topical application or cutaneous, subcutaneous, intraperitoneal, parenteral or intravenous injection. Intravenous administration to the patient is preferred.

Alternately, one may administer the compound in a local rather than systemic manner, for example, via injection of the compound directly into a arthritic joints or in fibrotic tissue, often in a depot or sustained release formulation. In order to prevent the scarring process frequently occurring as complication of glaucoma surgery, the compounds may be administered topically, for example, as eye drops. Furthermore, one may administer the drug in a targeted drug delivery system, for example, in a liposome coated with a specific antibody, targeting, for example, arthritic or fibrotic tissue. The liposomes will be targeted to and taken up selectively by the afflicted tissue.

The polypeptides of the invention are administered by any route that delivers an effective dosage to the desired site of action. The determination of a suitable route of administration and an effective dosage for a particular indication is within the level of skill in the art. Preferably for wound treatment, one administers the therapeutic compound directly to the site. Suitable dosage ranges for the polypeptides of the invention can be extrapolated from these dosages or from similar studies in appropriate animal models. Dosages can then be adjusted as necessary by the clinician to provide maximal therapeutic benefit.

4.9.2 COMPOSITIONS/FORMULATIONS

Pharmaceutical compositions for use in accordance with the present invention thus may be formulated in a conventional manner using one or more physiologically acceptable carriers comprising excipients and auxiliaries which facilitate processing of the active compounds into preparations which can be used pharmaceutically. These pharmaceutical compositions may be manufactured in a manner that is itself known, e.g., by means of conventional mixing, dissolving, granulating, dragee-making, levigating, emulsifying, encapsulating, entrapping or lyophilizing processes. Proper formulation is dependent upon the route of administration chosen. When a therapeutically effective amount of protein or other active ingredient of the present invention is administered orally, protein or other active ingredient of the present invention will be in the form of a tablet, capsule, powder, solution or elixir. When administered in tablet form, the pharmaceutical composition of the invention may additionally contain a solid carrier such as a gelatin or an adjuvant. The tablet, capsule, and powder contain from about 5 to 95% protein or other active ingredient of the present invention, and preferably from about 25 to 90% protein or other active ingredient of the present invention. When administered in liquid form, a liquid carrier such as water, petroleum, oils of animal or plant origin such as peanut oil, mineral oil, soybean oil, or sesame oil, or synthetic oils may be added. The liquid form of the pharmaceutical composition may further contain physiological saline solution, dextrose or other saccharide solution, or glycols such as ethylene glycol, propylene glycol or polyethylene glycol. When administered in liquid form, the pharmaceutical composition contains from about 0.5 to 90% by weight of protein or other active ingredient of the present invention, and preferably from about 1 to 50% protein or other active ingredient of the present invention.

When a therapeutically effective amount of protein or other active ingredient of the present invention is administered by intravenous, cutaneous or subcutaneous injection, protein or other active ingredient of the present invention will be in the form of a pyrogen-free, parenterally acceptable aqueous solution. The preparation of such parenterally acceptable protein or other active ingredient solutions, having due regard to pH, isotonicity, stability, and the like, is within the skill in the art. A preferred pharmaceutical composition for intravenous, cutaneous, or subcutaneous injection should contain, in addition to protein or other active ingredient of the present invention, an isotonic vehicle such as Sodium Chloride Injection, Ringer's Injection, Dextrose Injection, Dextrose and Sodium Chloride Injection, Lactated Ringer's Injection, or other vehicle as known in the art. The pharmaceutical composition of the present invention may also contain stabilizers, preservatives, buffers, antioxidants, or other additives known to those of skill in the art. For injection, the agents of the invention may be formulated in aqueous solutions, preferably in physiologically compatible buffers such as Hanks's solution, Ringer's solution, or physiological saline buffer. For transmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions and the like, for oral ingestion by a patient to be treated. Pharmaceutical preparations for oral use can be obtained from a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate. Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for such administration. For buccal administration, the compositions may take the form of tablets or lozenges formulated in conventional manner.

For administration by inhalation, the compounds for use according to the present invention are conveniently delivered in the form of an aerosol spray presentation from pressurized packs or a nebuliser, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of, e.g., gelatin for use in an inhaler or insufflator may be formulated containing a powder mix of the compound and a suitable powder base such as lactose or starch. The compounds may be formulated for parenteral administration by injection, e.g., by bolus injection or continuous infusion. Formulations for injection may be presented in unit dosage form, e.g., in ampules or in multi-dose containers, with an added preservative. The compositions may take such forms as suspensions, solutions or emulsions in oily or aqueous vehicles, and may contain formulatory agents such as suspending, stabilizing and/or dispersing agents.

Pharmaceutical formulations for parenteral administration include aqueous solutions of the active compounds in water-soluble form. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions. Alternatively, the active ingredient may be in powder form for constitution with a suitable vehicle, e.g., sterile pyrogen-free water, before use.

The compounds may also be formulated in rectal compositions such as suppositories or retention enemas, e.g., containing conventional suppository bases such as cocoa butter or other glycerides. In addition to the formulations described previously, the compounds may also be formulated as a depot preparation. Such long acting formulations may be administered by implantation (for example subcutaneously or intramuscularly) or by intramuscular injection. Thus, for example, the compounds may be formulated with suitable polymeric or hydrophobic materials (for example as an emulsion in an acceptable oil) or ion exchange resins, or as sparingly soluble derivatives, for example, as a sparingly soluble salt.

A pharmaceutical carrier for the hydrophobic compounds of the invention is a co-solvent system comprising benzyl alcohol, a nonpolar surfactant, a water-miscible organic polymer, and an aqueous phase. The co-solvent system may be the VPD co-solvent system. VPD is a solution of 3% w/v benzyl alcohol, 8% w/v of the nonpolar surfactant polysorbate 80, and 65% w/v polyethylene glycol 300, made up to volume in absolute ethanol. The VPD co-solvent system (VPD:5W) consists of VPD diluted 1:1 with a 5% dextrose in water solution. This co-solvent system dissolves hydrophobic compounds well, and itself produces low toxicity upon systemic administration. Naturally, the proportions of a co-solvent system may be varied considerably without destroying its solubility and toxicity characteristics. Furthermore, the identity of the co-solvent components may be varied: for example, other low-toxicity nonpolar surfactants may be used instead of polysorbate 80; the fraction size of polyethylene glycol may be varied; other biocompatible polymers may replace polyethylene glycol, e.g. polyvinyl pyrrolidone; and other sugars or polysaccharides may substitute for dextrose. Alternatively, other delivery systems for hydrophobic pharmaceutical compounds may be employed. Liposomes and emulsions are well known examples of delivery vehicles or carriers for hydrophobic drugs. Certain organic solvents such as dimethylsulfoxide also may be employed, although usually at the cost of greater toxicity. Additionally, the compounds may be delivered using a sustained-release system, such as semipermeable matrices of solid hydrophobic polymers containing the therapeutic agent. Various types of sustained-release materials have been established and are well known by those skilled in the art. Sustained-release capsules may, depending on their chemical nature, release the compounds for a few weeks up to over 100 days. Depending on the chemical nature and the biological stability of the therapeutic reagent, additional strategies for protein or other active ingredient stabilization may be employed.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols. Many of the active ingredients of the invention may be provided as salts with pharmaceutically compatible counter ions. Such pharmaceutically acceptable base addition salts are those salts which retain the biological effectiveness and properties of the free acids and which are obtained by reaction with inorganic or organic bases such as sodium hydroxide, magnesium hydroxide, ammonia, trialkylamine, dialkylamine, monoalkylamine, dibasic amino acids, sodium acetate, potassium benzoate, triethanol amine and the like.

The pharmaceutical composition of the invention may be in the form of a complex of the protein(s) or other active ingredient(s) of present invention along with protein or peptide antigens. The protein and/or peptide antigen will deliver a stimulatory signal to both B and T lymphocytes. B lymphocytes will respond to antigen through their surface immunoglobulin receptor. T lymphocytes will respond to antigen through the T cell receptor (TCR) following presentation of the antigen by MHC proteins. MHC and structurally related proteins including those encoded by class I and class II MHC genes on host cells will serve to present the peptide antigen(s) to T lymphocytes. The antigen components could also be supplied as purified MHC-peptide complexes alone or with co-stimulatory molecules that can directly signal T cells. Alternatively antibodies able to bind surface immunoglobulin and other molecules on B cells as well as antibodies able to bind the TCR and other molecules on T cells can be combined with the pharmaceutical composition of the invention.

The pharmaceutical composition of the invention may be in the form of a liposome in which protein of the present invention is combined, in addition to other pharmaceutically acceptable carriers, with amphipathic agents such as lipids which exist in aggregated form as micelles, insoluble monolayers, liquid crystals, or lamellar layers in aqueous solution. Suitable lipids for liposomal formulation include, without limitation, monoglycerides, diglycer ides, sulfatides, lysolecithins, phospholipids, saponin, bile acids, and the like. Preparation of such liposomal formulations is within the level of skill in the art, as disclosed, for example, in U.S. Pat. Nos. 4,235,871; 4,501,728; 4,837,028; and 4,737,323, all of which are incorporated herein by reference.

The amount of protein or other active ingredient of the present invention in the pharmaceutical composition of the present invention will depend upon the nature and severity of the condition being treated, and on the nature of prior treatments which the patient has undergone. Ultimately, the attending physician will decide the amount of protein or other active ingredient of the present invention wi th which to treat each individual patient. Initially, the attending physician will administer low doses of protein or other active ingredient of the present invention and observe the patient's response. Larger doses of protein or other active ingredient of the present invention may be administered until the optimal therapeutic effect is obtained for the patient, and at that point the dosage is not increased further. It is contemplated that the various pharmaceutical compositions used to practice the method of the present invention should contain about 0.01 $\mu$g to about 100 $\mu$g (preferably about 0.1 $\mu$g to about 10 mg, more preferably about 0.1 $\mu$g to about 1 mg) of protein or other active ingredient of the present invention per kg body weight. For compositions of the present invention which are useful for bone, cartilage, tendon or ligament regeneration, the therapeutic method includes administering the composition topically, systematically, or locally as an implant or device. When administered, the therapeutic composition for use in this invention is, of course, in a pyrogen-free, physiologically acceptable form. Further, the composition may desirably be encapsulated or injected in a viscous form for delivery to the site of bone, cartilage or tissue damage. Topical administration may be suitable for wound healing and tissue repair. Therapeutically useful agents other than a protein or other active ingredient of the invention which may also optionally be included in the composition as described above, may alternatively or additionally, be administered simultaneously or sequentially with the composition in the methods of the invention. Preferably for bone and/or cartilage formation, the composition would include a matrix capable of delivering the protein-containing or other active ingredient-containing composition to the site of bone and/or cartilage damage, providing a structure for the developing bone and cartilage and optimally capable of being resorbed into the body. Such matrices may be formed of materials presently in use for other implanted medical applications.

The choice of matrix material is based on biocompatibility, biodegradability, mechanical properties, cosmetic appearance and interface properties. The particular application of the compositions will define the appropriate formulation. Potential matrices for the compositions may be biodegradable and chemically defined calcium sulfate, tricalcium phosphate, hydroxyapatite, polylactic acid, polyglycolic acid and polyanhydrides. Other potential materials are biodegradable and biologically well-defined, such as bone or dermal collagen. Further matrices are comprised of pure proteins or extracellular matrix components. Other potential matrices are nonbiodegradable and chemically defined, such as sintered hydroxyapatite, bioglass, aluminates, or other ceramics. Matrices may be comprised of combinations of any of the above mentioned types of material, such as polylactic acid and hydroxyapatite or collagen and tricalcium phosphate. The bioceramics may be altered in composition, such as in calcium-aluminate-phosphate and processing to alter pore size, particle size, particle shape, and biodegradability. Presently preferred is a 50:50 (mole weight) copolymer of lactic acid and glycolic acid in the form of porous particles having diameters ranging from 150 to 800 microns. In some applications, it will be useful to utilize a sequestering agent, such as carboxymethyl cellulose or autologous blood clot, to prevent the protein compositions from disassociating from the matrix.

A preferred family of sequestering agents is cellulosic materials such as alkylcelluloses (including hydroxyalkylcelluloses), including methylcellulose, ethylcellulose, hydroxyethylcellulose, hydroxypropylcellulose, hydroxypropyl-methylcellulose, and carboxymethylcellulose, the most preferred being cationic salts of carboxymethylcellulose (CMC). Other preferred sequestering agents include hyaluronic acid, sodium alginate, poly(ethylene glycol), polyoxyethylene oxide, carboxyvinyl polymer and poly(vinyl alcohol). The amount of sequestering agent useful herein is 0.5–20 wt %, preferably 1–10 wt % based on total formulation weight, which represents the amount necessary to prevent desorption of the protein from the polymer matrix and to provide appropriate handling of the composition, yet not so much that the progenitor cells are prevented from infiltrating the matrix, thereby providing the protein the opportunity to assist the osteogenic activity of the progenitor cells. In further compositions, proteins or other active ingredients of the invention may be combined with other agents beneficial to the treatment of the bone and/or cartilage defect, wound, or tissue in question. These agents include various growth factors such as epidermal growth factor (EGF), platelet derived growth factor (PDGF), transforming growth factors (TGF-α and TGF-β), and insulin-like growth factor (IGF).

The therapeutic compositions are also presently valuable for veterinary applications. Particularly domestic animals and thoroughbred horses, in addition to humans, are desired patients for such treatment with proteins or other active ingredients of the present invention. The dosage regimen of a protein-containing pharmaceutical composition to be used in tissue regeneration will be determined by the attending physician considering various factors which modify the action of the proteins, e.g., amount of tissue weight desired to be formed, the site of damage, the condition of the damaged tissue, the size of a wound, type of damaged tissue (e.g., bone), the patient's age, sex, and diet, the severity of any infection, time of administration and other clinical factors. The dosage may vary with the type of matrix used in the reconstitution and with inclusion of other proteins in the pharmaceutical composition. For example, the addition of other known growth factors, such as IGF I (insulin like growth factor I), to the final composition, may also effect the dosage. Progress can be monitored by periodic assessment of tissue/bone growth and/or repair, for example, X-rays, histomorphometric determinations and tetracycline labeling.

Polynucleotides of the present invention can also be used for gene therapy. Such polynucleotides can be introduced either in vivo or ex vivo into cells for expression in a mammalian subject. Polynucleotides of the invention may also be administered by other known methods for introduction of nucleic acid into a cell or organism (including, without limitation, in the form of viral vectors or naked DNA). Cells may also be cultured ex vivo in the presence of proteins of the present invention in order to proliferate or to produce a desired effect on or activity in such cells. Treated cells can then be introduced in vivo for therapeutic purposes.

4.9.3 EFFECTIVE DOSAGE

Pharmaceutical compositions suitable for use in the present invention include compositions wherein the active ingredients are contained in an effective amount to achieve its intended purpose. More specifically, a therapeutically effective amount means an amount effective to prevent development of or to alleviate the existing symptoms of the subject being treated. Determination of the effective amount is well within the capability of those skilled in the art, especially in light of the detailed disclosure provided herein.

For any compound used in the method of the invention, the therapeutically effective dose can be estimated initially from appropriate in vitro assays. For example, a dose can be formulated in animal models to achieve a circulating concentration range that can be used to more accurately determine useful doses in humans. For example, a dose can be formulated in animal models to achieve a circulating concentration range that includes the $IC_{50}$ as determined in cell culture (i.e., the concentration of the test compound which achieves a half-maximal inhibition of the protein's biological activity). Such information can be used to more accurately determine useful doses in humans.

A therapeutically effective dose refers to that amount of the compound that results in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio between $LD_{50}$ and $ED_{50}$. Compounds which exhibit high therapeutic indices are preferred. The data obtained from these cell culture assays and animal studies can be used in formulating a range of dosage for use in human. The dosage of such compounds lies preferably within a range of circulating concentrations that include the $ED_{50}$ with little or no toxicity. The dosage may vary within this range depending upon the dosage form employed and the route of administration utilized. The exact formulation, route of administration and dosage can be chosen by the individual physician in view of the patient's condition. See, e.g., Fingl et al., 1975, in "The Pharmacological Basis of Therapeutics", Ch. 1 p. 1. Dosage amount and interval may be adjusted individually to provide plasma levels of the active moiety which are sufficient to maintain the desired effects, or minimal effective concentration (MEC). The MEC will vary for each compound but can be estimated from in vitro data. Dosages necessary to achieve the MEC will depend on individual characteristics and route of administration. However, HPLC assays or bioassays can be used to determine plasma concentrations.

Dosage intervals can also be determined using MEC value. Compounds should be administered using a regimen which maintains plasma levels above the MEC for 10–90% of the time, preferably between 30–90% and most preferably between 50–90%. In cases of local administration or selective uptake, the effective local concentration of the drug may not be related to plasma concentration.

An exemplary dosage regimen for polypeptides or other compositions of the invention will be in the range of about 0.01 µg/kg to 100 mg/kg of body weight daily, with the preferred dose being about 0.1 µg/kg to 25 mg/kg of patient body weight daily, varying in adults and children. Dosing may be once daily, or equivalent doses may be delivered at longer or shorter intervals.

The amount of composition administered will, of course, be dependent on the subject being treated, on the subject's age and weight, the severity of the affliction, the manner of administration and the judgment of the prescribing physician.

4.9.4 PACKAGING

The compositions may, if desired, be presented in a pack or dispenser device which may contain one or more unit dosage forms containing the active ingredient. The pack may, for example, comprise metal or plastic foil, such as a blister pack. The pack or dispenser device may be accompanied by instructions for administration. Compositions comprising a compound of the invention formulated in a compatible pharmaceutical carrier may also be prepared, placed in an appropriate container, and labeled for treatment of an indicated condition.

4.10 ANTIBODIES

Another aspect of the invention is an antibody that specifically binds the polypeptide of the invention. Such antibodies include monoclonal and polyclonal antibodies, single chain antibodies, chimeric antibodies, bifunctional/bispecific antibodies, humanized antibodies, human antibodies, and complementary determining region (CDR)-grafted antibodies, including compounds which include CDR and/or antigen-binding sequences, which specifically recognize a polypeptide of the invention. Preferred antibodies of the invention are human antibodies which are produced and identified according to methods described in WO93/11236, published Jun. 20, 1993, which is incorporated herein by reference in its entirety. Antibody fragments, including Fab, Fab', F(ab')$_2$, and F$_v$, are also provided by the invention. The term "specific for" indicates that the variable regions of the antibodies of the invention recognize and bind polypeptides of the invention exclusively (i.e., able to distinguish the polypeptide of the invention from other similar polypeptides despite sequence identity, homology, or similarity found in the family of polypeptides), but may also interact with other proteins (for example, S. aureus protein A or other antibodies in ELISA techniques) through interactions with sequences outside the variable region of the antibodies, and in particular, in the constant region of the molecule. Screening assays to determine binding specificity of an antibody of the invention are well known and routinely practiced in the art. For a comprehensive discussion of such assays, see Harlow et al. (Eds), Antibodies A Laboratory Manual; Cold Spring Harbor Laboratory; Cold Spring Harbor, N.Y. (1988), Chapter 6. Antibodies that recognize and bind fragments of the polypeptides of the invention are also contemplated, provided that the antibodies are first and foremost specific for, as defined above, full length polypeptides of the invention. As with antibodies that are specific for full length polypeptides of the invention, antibodies of the invention that recognize fragments are those which can distinguish polypeptides from the same family of polypeptides despite inherent sequence identity, homology, or similarity found in the family of proteins. Antibodies of the invention can be produced using any method well known and routinely practiced in the art.

Non-human antibodies may be humanized by any methods known in the art. In one method, the non-human CDRs are inserted into a human antibody or consensus antibody framework sequence. Further changes can then be introduced into the antibody framework to modulate affinity or immunogenicity.

Antibodies of the invention are useful for, for example, therapeutic purposes (by modulating activity of a polypeptide of the invention), diagnostic purposes to detect or quantitate a polypeptide of the invention, as well as purification of a polypeptide of the invention. Kits comprising an antibody of the invention for any of the purposes described herein are also comprehended. In general, a kit of the invention also includes a control antigen for which the antibody is immunospecific. The invention further provides a hybridoma that produces an antibody according to the invention. Antibodies of the invention are useful for detection and/or purification of the polypeptides of the invention.

Polypeptides of the invention may also be used to immunize animals to obtain polyclonal and monoclonal antibodies which specifically react with the protein. Such antibodies may be obtained using either the entire protein or fragments thereof as an immunogen. The peptide immunogens additionally may contain a cysteine residue at the carboxyl terminus, and are conjugated to a hapten such as keyhole limpet hemocyanin (KLH). Methods for synthesizing such peptides are known in the art, for example, as in R. P. Merrifield, J. Amer. Chem. Soc. 85, 2149–2154 (1963); J. L. Krstenansky, et al., FEBS Lett. 211, 10 (1987).

Monoclonal antibodies binding to the protein of the invention may be useful diagnostic agents for the immunodetection of the protein. Neutralizing monoclonal antibodies binding to the protein may also be useful therapeutics for both conditions associated with the protein and also in the treatment of some forms of cancer where abnormal expression of the protein is involved. In the case of cancerous cells or leukemic cells, neutralizing monoclonal antibodies against the protein may be useful in detecting and preventing the metastatic spread of the cancerous cells, which may be mediated by the protein. In general, techniques for preparing polyclonal and monoclonal antibodies as well as hybridomas capable of producing the desired antibody are well known in the art (Campbell, A. M., Monoclonal Antibodies Technology: Laboratory Techniques in Biochemistry and Molecular Biology, Elsevier Science Publishers, Amsterdam, The Netherlands (1984); St. Groth et al., J. Immunol. 35:1–21 (1990); Kohler and Milstein, Nature 256:495497 (1975)), the trioma technique, the human B-cell hybridoma technique (Kozbor et al., Immunology Today 4:72 (1983); Cole et al., in Monoclonal Antibodies and Cancer Therapy, Alan R. Liss, Inc. (1985), pp. 77–96).

Any animal (mouse, rabbit, etc.) which is known to produce antibodies can be immunized with a peptide or polypeptide of the invention. Methods for immunization are well known in the art. Such methods include subcutaneous or intraperitoneal injection of the polypeptide. One skilled in the art will recognize that the amount of the protein encoded by the ORF of the present invention used for immunization will vary based on the animal which is immunized, the antigenicity of the peptide and the site of injection. The protein that is used as an immunogen may be modified or administered in an adjuvant in order to increase the protein's antigenicity. Methods of increasing the antigenicity of a protein are well known in the art and include, but are not limited to, coupling the antigen with a heterologous protein (such as globulin or -galactosidase) or through the inclusion of an adjuvant during immunization.

For monoclonal antibodies, spleen cells from the immunized animals are removed, fused with myeloma cells, such as SP2/0-Ag14 myeloma cells, and allowed to become monoclonal antibody producing hybridoma cells. Any one of a number of methods well known in the art can be used to identify the hybridoma cell which produces an antibody with the desired characteristics. These include screening the hybridomas with an ELISA assay, Western blot analysis, or radioimmunoassay (Lutz et al., Exp. Cell Research. 175:109–124 (1988)). Hybridomas secreting the desired antibodies are cloned and the class and subclass is determined using procedures known in the art (Campbell, A. M., Monoclonal Antibody Technology: Laboratory Techniques in Biochemistry and Molecular Biology, Elsevier Science Publishers, Amsterdam, The Netherlands (1984)). Techniques described for the production of single chain antibodies (U.S. Pat. No. 4,946,778) can be adapted to produce single chain antibodies to proteins of the present invention.

For polyclonal antibodies, antibody-containing antiserum is isolated from the immunized animal and is screened for the presence of antibodies with the desired specificity using one of the above-described procedures. The present invention further provides the above- described antibodies in delectably labeled form. Antibodies can be delectably labeled through the use of radioisotopes, affinity labels (such as biotin, avidin, etc.), enzymatic labels (such as horseradish peroxidase, alkaline phosphatase, etc.) fluorescent labels (such as FITC or rhodamine, etc.), paramagnetic atoms, etc. Procedures for accomplishing such labeling are well-known in the art, for example, see (Sternberger, L. A. et al., J. Histochem. Cytochem. 18:315 (1970); Bayer, E. A. et al., Meth. Enzym. 62:308 (1979); Engval, E. et al., Immunol. 109:129 (1972); Goding, J. W. J. Immunol. Meth. 13:215 (1976)).

The labeled antibodies of the present invention can be used for in vitro, in vivo, and in situ assays to identify cells or tissues in which a fragment of the polypeptide of interest is expressed. The antibodies may also be used directly in therapies or other diagnostics. The present invention further provides the above-described antibodies immobilized on a solid support. Examples of such solid supports include plastics such as polycarbonate, complex carbohydrates such as agarose and Sepharose®, acrylic resins and such as polyacrylamide and latex beads. Techniques for coupling antibodies to such solid supports are well known in the art (Weir, D. M. et al., "Handbook of Experimental Immunology" 4th Ed., Blackwell Scientific Publications, Oxford, England, Chapter 10 (1986); Jacoby, W. D. et al., Meth. Enzym. 34 Academic Press, N.Y. (1974)). The immobilized antibodies of the present invention can be used for in vitro, in vivo, and in situ assays as well as for immuno-affinity purification of the proteins of the present invention.

4.11 COMPUTER READABLE SEQUENCES

In one application of this embodiment, a nucleotide sequence of the present invention can be recorded on computer readable media. As used herein, "computer readable media" refers to any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention. As used herein, "recorded" refers to a process for storing information on computer readable medium. A skilled artisan can readily adopt any of the presently known methods for recording information on computer readable medium to generate manufactures comprising the nucleotide sequence information of the present invention.

A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing any of the nucleotide sequences SEQ ID NOs: 1–1104 or a representative fragment thereof; or a nucleotide sequence at least 95% identical to any of the nucleotide sequences of the SEQ ID NOs: 1–1104 in computer readable form, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., J. Mol. Biol. 215:403–410 (1990)) and BLAZE (Brutlag et al., Comp. Chem. 17:203–207 (1993)) search algorithms on a Sybase system is used to identify open reading frames (ORFs) within a nucleic acid sequence. Such ORFs may be protein encoding fragments and may be useful in producing commercially important proteins such as enzymes used in fermentation reactions and in the production of commercially useful metabolites.

As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based systems are suitable for use in the present invention. As stated above, the computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of a known sequence which match a particular target sequence or target motif. A variety of known algorithms are disclosed publicly and a variety of commercially available software for conducting search means are and can be used in the computer-based systems of the present invention. Examples of such software includes, but is not limited to, Smith-Waterman, MacPattern (EMBL), BLASTN and BLASTA (NPOLYPEPTIDEIA). A skilled artisan can readily recognize that any one of the available algorithms or implementing software packages for conducting homology searches can be adapted for use in the present computer-based systems. As used herein, a "target sequence" can be any nucleic acid or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 300 amino acids, more preferably from about 30 to 100 nucleotide residues. However, it is well recognized that searches for commercially important fragments, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences. Nucleic acid target motifs include, but are not limited to, promoter sequences, hairpin structures and inducible expression elements (protein binding sequences).

4.12 TRIPLE HELIX FORMATION

In addition, the fragments of the present invention, as broadly described, can be used to control gene expression through triple helix formation or antisense DNA or RNA, both of which methods are based on the binding of a polynucleotide sequence to DNA or RNA. Polynucleotides suitable for use in these methods are preferably 20 to 40 bases in length and are designed to be complementary to a region of the gene involved in transcription (triple helix—see Lee et al., Nucl. Acids Res. 6:3073 (1979); Cooney et al., Science 15241:456 (1988); and Dervan et al., Science 251:1360 (1991)) or to the mRNA itself (antisense—Olmno, J. Neurochem. 56:560 (1991); Oligodeoxynucleotides as Antisense Inhibitors of Gene Expression, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide.

4.13 DIAGNOSTIC ASSAYS AND KITS

The present invention further provides methods to identify the presence or expression of one of the ORFs of the present invention, or homolog thereof, in a test sample, using a nucleic acid probe or antibodies of the present invention, optionally conjugated or otherwise associated with a suitable label.

In general, methods for detecting a polynucleotide of the invention can comprise contacting a sample with a compound that binds to and forms a complex with the polynucleotide for a period sufficient to form the complex, and detecting the complex, so that if a complex is detected, a polynucleotide of the invention is detected in the sample. Such methods can also comprise contacting a sample under stringent hybridization conditions with nucleic acid primers that anneal to a polynucleotide of the invention under such conditions, and amplifying annealed polynucleotides, so that if a polynucleotide is amplified, a polynucleotide of the invention is detected in the sample.

In general, methods for detecting a polypeptide of the invention can comprise contacting a sample with a compound that binds to and forms a complex with the polypeptide for a period sufficient to form the complex, and detecting the complex, so that if a complex is detected, a polypeptide of the invention is detected in the sample.

In detail, such methods comprise incubating a test sample with one or more of the antibodies or one or more of the nucleic acid probes of the present invention and assaying for binding of the nucleic acid probes or antibodies to components within the test sample.

Conditions for incubating a nucleic acid probe or antibody with a test sample vary. Incubation conditions depend on the format employed in the assay, the detection methods employed, and the type and nature of the nucleic acid probe or antibody used in the assay. One skilled in the art will recognize that any one of the commonly available hybridization, amplification or immunological assay formats can readily be adapted to employ the nucleic acid probes or antibodies of the present invention. Examples of such assays can be found in Chard, T., An Introduction to Radioimmunoassay and Related Techniques, Elsevier Science Publishers, Amsterdam, The Netherlands (1986); Bullock, G. R. et al., Techniques in Immunocytochemistry, Academic Press, Orlando, Fla. Vol. 1 (1982), Vol. 2 (1983), Vol. 3 (1985); Tijssen, P., Practice and Theory of immunoassays: Laboratory Techniques in Biochemistry and Molecular Biology, Elsevier Science Publishers, Amsterdam, The Netherlands (1985). The test samples of the present invention include cells, protein or membrane extracts of cells, or biological fluids such as sputum, blood, serum, plasma, or urine. The test sample used in the above-described method will vary based on the assay format, nature of the detection method and the tissues, cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention. Specifically, the invention provides a compartment kit to receive, in close confinement, one or more containers which comprises: (a) a first container comprising one of the probes or antibodies of the present invention; and (b) one or more other containers comprising one or more of the following: wash reagents, reagents capable of detecting presence of a bound probe or antibody.

In detail, a compartment kit includes any kit in which reagents are contained in separate containers. Such containers include small glass containers, plastic containers or strips of plastic or paper. Such containers allows one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody or probe. Types of detection reagents include labeled nucleic acid probes, labeled secondary antibodies, or in the alternative, if the primary antibody is labeled, the enzymatic, or antibody binding reagents which are capable of reacting with the labeled antibody. One skilled in the art will readily recognize that the disclosed probes and antibodies of the present invention can be readily incorporated into one of the established kit formats which are well known in the art.

4.14 MEDICAL IMAGING

The novel polypeptides and binding partners of the invention are useful in medical imaging of sites expressing the molecules of the invention (e.g., where the polypeptide of the invention is involved in the immune response, for imaging sites of inflammation or infection). See, e.g., Kunkel et al., U.S. Pat. No. 5,413,778. Such methods involve chemical attachment of a labeling or imaging agent, administration of the labeled polypeptide to a subject in a pharmaceutically acceptable carrier, and imaging the labeled polypeptide in vivo at the target site.

4.15 SCREENING ASSAYS

Using the isolated proteins and polynucleotides of the invention, the present invention further provides methods of obtaining and identifying agents which bind to a polypeptide encoded by an ORF corresponding to any of the nucleotide sequences set forth in the SEQ ID NOs: 1–1104, or bind to a specific domain of the polypeptide encoded by the nucleic acid. In detail, said method comprises the steps of:

(a) contacting an agent with an isolated protein encoded by an ORF of the present invention, or nucleic acid of the invention; and (b) determining whether the agent binds to said protein or said nucleic acid.

In general, therefore, such methods for identifying compounds that bind to a polynucleotide of the invention can comprise contacting a compound with a polynucleotide of the invention for a time sufficient to form a polynucleotide/compound complex, and detecting the complex, so that if a polynucleotide/compound complex is detected, a compound that binds to a polynucleotide of the invention is identified.

Likewise, in general, therefore, such methods for identifying compounds that bind to a polypeptide of the invention can comprise contacting a compound with a polypeptide of the invention for a time sufficient to form a polypeptide/compound complex, and detecting the complex, so that if a polypeptide/compound complex is detected, a compound that binds to a polynucleotide of the invention is identified.

Methods for identifying compounds that bind to a polypeptide of the invention can also comprise contacting a compound with a polypeptide of the invention in a cell for a time sufficient to form a polypeptide/compound complex, wherein the complex drives expression of a receptor gene sequence in the cell, and detecting the complex by detecting reporter gene sequence expression, so that if a polypeptide/compound complex is detected, a compound that binds a polypeptide of the invention is identified.

Compounds identified via such methods can include compounds which modulate the activity of a polypeptide of the invention (that is, increase or decrease its activity, relative to activity observed in the absence of the compound). Alternatively, compounds identified via such methods can include compounds which modulate the expression of a polynucleotide of the invention (that is, increase or decrease expression relative to expression levels observed in the absence of the compound). Compounds, such as compounds identified via the methods of the invention, can be tested using standard assays well known to those of skill in the art for their ability to modulate activity/expression.

The agents screened in the above assay can be, but are not limited to, peptides, carbohydrates, vitamin derivatives, or other pharmaceutical agents. The agents can be selected and screened at random or rationally selected or designed using protein modeling techniques.

For random screening, agents such as peptides, carbohydrates, pharmaceutical agents and the like are selected at random and are assayed for their ability to bind to the protein encoded by the ORF of the present invention. Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like, capable of binding to a specific peptide sequence, in order to generate rationally designed antipeptide peptides, for example see Hurby et al., Application of Synthetic Peptides: Antisense Peptides," In Synthetic Peptides, A User's Guide, W. H. Freeman, NY (1992), pp. 289–307, and Kaspczak et al., Biochemistry 28:9230–8 (1989), or pharmaceutical agents, or the like.

In addition to the foregoing, one class of agents of the present invention, as broadly described, can be used to control gene expression through binding to one of the ORFs or EMFs of the present invention. As described above, such agents can be randomly screened or rationally designed/selected. Targeting the ORF or EMF allows a skilled artisan to design sequence specific or element specific agents, modulating the expression of either a single ORF or multiple ORFs which rely on the same EMF for expression control. One class of DNA binding agents are agents which contain base residues which hybridize or form a triple helix formation by binding to DNA or RNA. Such agents can be based on the classic phosphodiester, ribonucleic acid backbone, or can be a variety of sulfhydryl or polymeric derivatives which have base attachment capacity.

Agents suitable for use in these methods preferably contain 20 to 40 bases and are designed to be complementary to a region of the gene involved in transcription (triple helix—see Lee et al., Nucl. Acids Res. 6:3073 (1979); Cooney et al., Science 241:456 (1988); and Dervan et al., Science 251:1360 (1991)) or to the mRNA itself (antisense—Okano, J. Neurochem. 56:560 (1991); Oligodeoxynucleotides as Antisense Inhibitors of Gene Expression, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide and other DNA binding agents.

Agents which bind to a protein encoded by one of the ORFs of the present invention can be used as a diagnostic agent. Agents which bind to a protein encoded by one of the ORFs of the present invention can be formulated using known techniques to generate a pharmaceutical composition.

4.16 USE OF NUCLEIC ACIDS AS PROBES

Another aspect of the subject invention is to provide for polypeptide-specific nucleic acid hybridization probes capable of hybridizing with naturally occurring nucleotide sequences. The hybridization probes of the subject invention may be derived from any of the nucleotide sequences SEQ ID NOs: 1–1104. Because the corresponding gene is only expressed in a limited number of tissues, a hybridization probe derived from of any of the nucleotide sequences SEQ ID NOs: 1–1104 can be used as an indicator of the presence of RNA of cell type of such a tissue in a sample.

Any suitable hybridization technique can be employed, such as, for example, in situ hybridization. PCR as described in U.S. Pat. Nos. 4,683,195 and 4,965,188 provides additional uses for oligonucleotides based upon the nucleotide sequences. Such probes used in PCR may be of recombinant origin, may be chemically synthesized, or a mixture of both. The probe will comprise a discrete nucleotide sequence for the detection of identical sequences or a degenerate pool of possible sequences for identification of closely related genomic sequences.

Other means for producing specific hybridization probes for nucleic acids include the cloning of nucleic acid sequences into vectors for the production of mRNA probes. Such vectors are known in the art and are commercially available and may be used to synthesize RNA probes in vitro by means of the addition of the appropriate RNA polymerase as T7 or SP6 RNA polymerase and the appropriate radioactively labeled nucleotides. The nucleotide sequences may be used to construct hybridization probes for mapping their respective genomic sequences. The nucleotide sequence provided herein may be mapped to a chromosome or specific regions of a chromosome using well known genetic and/or chromosomal mapping techniques. These techniques include in situ hybridization, linkage analysis against known chromosomal markers, hybridization screening with libraries or flow-sorted chromosomal preparations specific to known chromosomes, and the like. The technique of fluorescent in situ hybridization of chromosome spreads has been described, among other places, in Verma et al (1988) Human Chromosomes: A Manual of Basic Techniques, Pergamon Press, New York N.Y.

Fluorescent in situ hybridization of chromosomal preparations and other physical chromosome mapping techniques may be correlated with additional genetic map data. Examples of genetic map data can be found in the 1994 Genome Issue of Science (265:1981f). Correlation between the location of a nucleic acid on a physical chromosomal map and a specific disease (or predisposition to a specific disease) may help delimit the region of DNA associated with that genetic disease. The nucleotide sequences of the subject invention may be used to detect differences in gene sequences between normal, carrier or affected individuals.

4.17 PREPARATION OF SUPPORT BOUND OLIGONUCLEOTIDES

Oligonucleotides, i.e., small nucleic acid segments, may be readily prepared by, for example, directly synthesizing the oligonucleotide by chemical means, as is commonly practiced using an automated oligonucleotide synthesizer.

Support bound oligonucleotides may be prepared by any of the methods known to those of skill in the art using any suitable support such as glass, polystyrene or Teflon. One strategy is to precisely spot oligonucleotides synthesized by standard synthesizers. Immobilization can be achieved using passive adsorption (Inouye & Hondo, (1990) J. Clin. Microbiol. 28(6) 1469–72); using UV light (Nagata et al., 1985; Dahlen et al., 1987; Morrissey & Collins, (1989) Mol. Cell Probes 3(2) 189–207) or by covalent binding of base modified DNA (Keller et al., 1988; 1989); all references being specifically incorporated herein.

Another strategy that may be employed is the use of the strong biotin-streptavidin interaction as a linker. For example, Broude et al. (1994) Proc. Natl. Acad. Sci. USA 91(8) 3072–6, describe the use of biotinylated probes, although these are duplex probes, that are immobilized on streptavidin-coated magnetic beads. Streptavidin-coated beads may be purchased from Dynal, Oslo. Of course, this same linking chemistry is applicable to coating any surface with streptavidin. Biotinylated probes may be purchased from various sources, such as, e.g., Operon Technologies (Alameda, Calif.).

Nunc Laboratories (Naperville, Ill.) is also selling suitable material that could be used. Nunc Laboratories have developed a method by which DNA can be covalently bound to the microwell surface termed Covalink NH. CovaLink NH is a polystyrene surface grafted with secondary amino groups (>NH) that serve as bridge-heads for further covalent coupling. CovaLink Modules may be purchased from Nunc Laboratories. DNA molecules may be bound to CovaLink exclusively at the 5'-end by a phosphoramidate bond, allowing immobilization of more than 1 pmol of DNA (Rasmussen et al., (1991) Anal. Biochem. 198(1) 13842).

The use of CovaLink NH strips for covalent binding of DNA molecules at the 5'-end has been described (Rasmussen et al., (1991). In this technology, a phosphoramidate bond is employed (Chu et al., (1983) Nucleic Acids Res. 11(8) 6513–29). This is beneficial as immobilization using only a single covalent bond is preferred. The phosphoramidate bond joins the DNA to the CovaLink NH secondary amino groups that are positioned at the end of spacer arms covalently grafted onto the polystyrene surface through a 2 nm long spacer arm. To link an oligonucleotide to CovaLink NH via an phosphoramidate bond, the oligonucleotide terminus must have a 5'-end phosphate group. It is, perhaps, even possible for biotin to be covalently bound to CovaLink and then streptavidin used to bind the probes.

More specifically, the linkage method includes dissolving DNA in water (7.5 ng/ul) and denaturing for 10 min. at 95° C. and cooling on ice for 10 min. Ice-cold 0.1 M 1-methylimidazole, pH 7.0 (1-MeIm$_7$), is then added to a final concentration of 10 mM 1-MeIm$_7$. A ss DNA solution is then dispensed into CovaLink NH strips (75 ul/well) standing on ice.

Carbodiimide 0.2 M 1-ethyl-3-(3-dimethylaminopropyl)-carbodiimide (EDC), dissolved in 10 mM 1-MeIm$_7$, is made fresh and 25 ul added per well. The strips are incubated for 5 hours at 50° C. After incubation the strips are washed using, e.g., Nunc-Immuno Wash; first the wells are washed 3 times, then they are soaked with washing solution for 5 min., and finally they are washed 3 times (where in the washing solution is 0.4 N NaOH, 0.25% SDS heated to 50° C.).

It is contemplated that a further suitable method for use with the present invention is that described in PCT Patent Application WO 90/03382 (Southern & Maskos), incorporated herein by reference. This method of preparing an oligonucleotide bound to a support involves attaching a nucleoside 3'-reagent through the phosphate group by a covalent phosphodiester link to aliphatic hydroxyl groups carried by the support. The oligonucleotide is then synthesized on the supported nucleoside and protecting groups removed from the synthetic oligonucleotide chain under standard conditions that do not cleave the oligonucleotide from the support. Suitable reagents include nucleoside phosphoramidite and nucleoside hydrogen phosphorate.

An on-chip strategy for the preparation of DNA probe for the preparation of DNA probe arrays may be employed. For example, addressable laser-activated photodeprotection may be employed in the chemical synthesis of oligonucleotides directly on a glass surface, as described by Fodor et al. (1991) Science 251(4995) 767–73, incorporated herein by reference. Probes may also be immobilized on nylon supports as described by Van Ness et al. (1991) Nucleic Acids Res. 19(12) 3345–50; or linked to Teflon using the method of Duncan & Cavalier (1988) Anal. Biochem. 169(1) 104–8; all references being specifically incorporated herein.

To link an oligonucleotide to a nylon support, as described by Van Ness et al. (1991), requires activation of the nylon surface via alkylation and selective activation of the 5'-amine of oligonucleotides with cyanuric chloride.

One particular way to prepare support bound oligonucleotides is to utilize the light-generated synthesis described by Pease et al., (1994) PNAS USA 91(11) 5022–6, incorporated herein by reference). These authors used current photolithographic techniques to generate arrays of immobilized oligonucleotide probes (DNA chips). These methods, in which light is used to direct the synthesis of oligonucleotide probes in high-density, miniaturized arrays, utilize photolabile 5'-protected N-acyl-deoxynucleoside phosphoramidites, surface linker chemistry and versatile combinatorial synthesis strategies. A matrix of 256 spatially defined oligonucleotide probes may be generated in this manner.

4.18 PREPARATION OF NUCLEIC ACID FRAGMENTS

The nucleic acids may be obtained from any appropriate source, such as cDNAs, genomic DNA, chromosomal DNA, microdissected chromosome bands, cosmid or YAC inserts, and RNA, including mRNA without any amplification steps. For example, Sambrook et al. (1989) describes three protocols for the isolation of high molecular weight DNA from mammalian cells (p. 9.14–9.23).

DNA fragments may be prepared as clones in M13, plasmid or lambda vectors and/or prepared directly from genomic DNA or cDNA by PCR or other amplification methods. Samples may be prepared or dispensed in multiwell plates. About 100–1000 ng of DNA samples may be prepared in 2–500 ml of final volume.

The nucleic acids would then be fragmented by any of the methods known to those of skill in the art including, for example, using restriction enzymes as described at 9.24–9.28 of Sambrook et al. (1989), shearing by ultrasound and NaOH treatment.

Low pressure shearing is also appropriate, as described by Schriefer et al. (1990) Nucleic Acids Res. 18(24) 7455–6, incorporated herein by reference). In this method, DNA samples are passed through a small French pressure cell at a variety of low to intermediate pressures. A lever device allows controlled application of low to intermediate pressures to the cell. The results of these studies indicate that low-pressure shearing is a useful alternative to sonic and enzymatic DNA fragmentation methods.

One particularly suitable way for fragmenting DNA is contemplated to be that using the two base recognition endonuclease, CviJI, described by Fitzgerald et al. (1992) Nucleic Acids Res. 20(14) 3753–62. These authors described an approach for the rapid fragmentation and fractionation of DNA into particular sizes that they contemplated to be suitable for shotgun cloning and sequencing.

The restriction endonuclease CviJI normally cleaves the recognition sequence PuGCPy between the G and C to leave blunt ends. Atypical reaction conditions, which alter the specificity of this enzyme (CviJI), yield a quasi-random distribution of DNA fragments form the small molecule pUC19 (2688 base pairs). Fitzgerald et al. (1992) quantitatively evaluated the randomness of this fragmentation strategy, using a CviJI digest of pUC19 that was size fractionated by a rapid gel filtration method and directly ligated, without end repair, to a lac Z minus M13 cloning vector. Sequence analysis of 76 clones showed that CviJI** restricts pyGCPy and PuGCPu, in addition to PuGCPy sites, and that new sequence data is accumulated at a rate consistent with random fragmentation.

As reported in the literature, advantages of this approach compared to sonication and agarose gel fractionation include: smaller amounts of DNA are required (0.2–0.5 ug instead of 2–5 ug); and fewer steps are involved (no preligation, end repair, chemical extraction, or agarose gel electrophoresis and elution are needed Irrespective of the manner in which the nucleic acid fragments are obtained or prepared, it is important to denature the DNA to give single stranded pieces available for hybridization. This is achieved by incubating the DNA solution for 2–5 minutes at 80–90° C. The solution is then cooled quickly to 2° C. to prevent renaturation of the DNA fragments before they are contacted with the chip. Phosphate groups must also be removed from genomic DNA by methods known in the art.

4.19 PREPARATION OF DNA ARRAYS

Arrays may be prepared by spotting DNA samples on a support such as a nylon membrane. Spotting may be performed by using arrays of metal pins (the positions of which correspond to an array of wells in a microtiter plate) to repeated by transfer of about 20 nl of a DNA solution to a nylon membrane. By offset printing, a density of dots higher than the density of the wells is achieved. One to 25 dots may be accommodated in 1 mm$^2$, depending on the type of label used. By avoiding spotting in some preselected number of rows and columns, separate subsets (subarrays) may be formed. Samples in one subarray may be the same genomic segment of DNA (or the same gene) from different individuals, or may be different, overlapped genomic clones. Each of the subarrays may represent replica spotting of the same samples. In one example, a selected gene segment may be amplified from 64 patients. For each patient, the amplified gene segment may be in one 96-well plate (all 96 wells containing the same sample). A plate for each of the 64 patients is prepared. By using a 96-pin device, all samples may be spotted on one 8×12 cm membrane. Subarrays may contain 64 samples, one from each patient. Where the 96 subarrays are identical, the dot span may be 1 mm$^2$ and there may be a 1 mm space between subarrays.

Another approach is to use membranes or plates (available from NUNC, Naperville, Ill.) which may be partitioned by physical spacers e.g. a plastic grid molded over the membrane, the grid being similar to the sort of membrane applied to the bottom of multiwell plates, or hydrophobic strips. A fixed physical spacer is not preferred for imaging by exposure to flat phosphor-storage screens or x-ray films.

The present invention is illustrated in the following examples. Upon consideration of the present disclosure, one of skill in the art will appreciate that many other embodiments and variations may be made in the scope of the present invention. Accordingly, it is intended that the broader aspects of the present invention not be limited to the disclosure of the following examples. The present invention is not to be limited in scope by the exemplified embodiments which are intended as illustrations of single aspects of the invention, and compositions and methods which are functionally equivalent are within the scope of the invention. Indeed, numerous modifications and variations in the practice of the invention are expected to occur to those skilled in the art upon consideration of the present preferred embodiments. Consequently, the only limitations which should be placed upon the scope of the invention are those which appear in the appended claims.

All references cited within the body of the instant specification are hereby incorporated by reference in their entirety.

5.0 EXAMPLES

5.1 Example 1

Novel Nucleic Acid Sequences Obtained From Various Libraries

A plurality of novel nucleic acids were obtained from cDNA libraries prepared from various human tissues and in some cases isolated from a genomic library derived from human chromosome using standard PCR, SBH sequence signature analysis and Sanger sequencing techniques. The inserts of the library were amplified with PCR using primers specific for the vector sequences which flank the inserts. Clones from cDNA libraries were spotted on nylon membrane filters and screened with oligonucleotide probes (e.g., 7-mers) to obtain signature sequences. The clones were clustered into groups of similar or identical sequences. Representative clones were selected for sequencing.

In some cases, the 5' sequence of the amplified inserts was then deduced using a typical Sanger sequencing protocol. PCR products were purified and subjected to fluorescent dye terminator cycle sequencing. Single pass gel sequencing was done using a 377 Applied Biosystems (ABI) sequencer to obtain the novel nucleic acid sequences. In some cases RACE (Random Amplification of cDNA Ends) was performed to further extend the sequence in the 5' direction.

5.2 Example 2

Novel Nucleic Acids

The novel nucleic acids of the present invention of the invention were assembled from sequences that were obtained from a cDNA library by methods described in Example 1 above, and in some cases sequences obtained from one or more public databases. The nucleic acids were assembled using an EST sequence as a seed. Then a recursive algorithm was used to extend the seed EST into an extended assemblage, by pulling additional sequences from different databases (i.e., Hyseq's database containing EST sequences, dbEST version 114, gb pri 114, and UniGene version 101) that belong to this assemblage. The algorithm terminated when there was no additional sequences from the above databases that would extend the assemblage. Inclusion of component sequences into the assemblage was based on a BLASTN hit to the extending assemblage with BLAST score greater than 300 and percent identity greater than 95%.

Using PHRAP (Univ. of Washington) or CAP4 (Paracel), a full length gene cDNA sequence and its corresponding protein sequence were generated from the assemblage. Any frame shifts and incorrect stop codons were corrected by hand editing. During editing, the sequence was checked using FASTY and/or BLAST against Genbank (i.e., dbEST version 117, gb pri 117, UniGene version 117, Genepet release 117). Other computer programs which may have been used in the editing process were phredPhrap and Consed (University of Washington) and ed-ready, ed-ext and gc-zip-2 (H yseq, Inc.). The full-length nucleotide and amino acid sequences, including splice variants resulting from these procedures are shown in the Sequence Listing as SEQ ID NOS: 1–1104.

Table 1 shows the various tissue sources of SEQ ID NO: 1–1104.

The nearest neighbor results for SEQ ID NO: 1–1104 were obtained by a BLASTP version 2.0al 19MP-WashU search against Genpept release 118, using BLAST algorithm. The nearest neighbor result showed the closest homologue for SEQ ID NO: 1–1104 from Genpept (and contains the translated amino acid sequences for which the nucleic acid sequence encodes). The nearest neighbor results for SEQ ID NO: 1–1104 are shown in Table 2 below.

TABLE 1

| TISSUE ORIGIN | RNA SOURCE | HYSEQ LIBRARY NAME | SEQ ID NOS: |
|---|---|---|---|
| adult brain | GIBCO | AB3001 | 4–5 7 29–30 35 42 52 55–56 90 97 117 133–134 147 149 151 162 170 174 177 193 201 222 250 258 263 285–286 290 295 311–312 323–324 330 336–337 339 348 351–353 360 369 377 379 392 398 408 415 459–461 480 489 496 542–544 547 554 584–585 597 599 606 609 611–616 620 623 649 666 675–676 683 688 691–693 695–696 706 727 735 748 753 756 759 767 771 796 802 805–806 820 823–826 829 838 840 846 869 895 919 924 931 933 948 962–963 969 978–980 984 997–998 1002 1010 1013 1020 1046 1050–1051 1058 1063–1065 1069 1081 1090 |
| adult brain | GIBCO | ABD003 | 2–4 6–7 18–22 29–30 52–54 66 74 82 88 93 98 100–102 104 107–110 112–113 117 119 123 127–128 133–135 142 145–147 150–152 157 165 168 170 174 177 181–182 190 193–195 200–202 209 211–215 |

TABLE 1-continued

| TISSUE ORIGIN | RNA SOURCE | HYSEQ LIBRARY NAME | SEQ ID NOS: |
|---|---|---|---|
| | | | 217–218 220 228 230 236 245–246 250–252 262–264 269 272 274 278 283–286 293–297 299–300 302 305–311 313–314 321 323–327 331 333–335 339–340 343–346 348 350–352 358 363 369 383 392–393 398 401 408–412 419 427 429–430 434 437 443 449–450 457 459–462 470 473 480 484–485 487–488 495–496 500 502 505–506 517 519–521 525 530–532 536 543–546 549 554 559 563 568 582 586–587 589–590 593 596 598–601 603 608–609 611–614 616 619–621 623–626 628–629 632 642–645 650 653–656 664 666–667 672–673 677 679–680 684–688 692–693 695 700 705–708 711–712 717–719 722 724 727 738 748 752–755 767 770–771 774–775 778 786 792 796 798 801 805–806 808 810 813 816 819 823 833–834 838 840 846–847 856 859 867 873 877 879 882–883 889 891 904–906 909 915–916 919 921 931 933 937 942 948 953 957 959 969 971 974 976–979 983–984 996–997 1002 1006–1010 1016 1023 1028 1031 1034 1038 1041 1045–1047 1058 1064 1067 1070 1076 1079–1080 1084 1090 1100 |
| adult brain | Clontech | ABR001 | 3–4 17 21 25 35 52 57 66 78 82 88 115–116 128 143 155 164 180 191 262 274 309 319 338 373 398 484 488 518 550 556 560 565 567 593 607 624 687 692–694 715 724 729 731 764 796 801 810 816 825–826 833–836 921 928–929 970 983 1010 1035 1045 1051 1073–1074 1090 |
| adult brain | Clontech | ABR006 | 9–11 14 25 30 32–33 35 42 47 52 57 66 69–70 88 93–94 100–102 104 115–116 127 180 293–294 340 371 469 483 530 598 706 742 798 802 813 837 856 876 896 916 952 955 975 1002 1007–1009 1014–1017 1034 1059 1071 1090 |
| adult brain | Clontech | ABR008 | 1 3–4 6–11 14 17–20 22 25 27 29–30 35 42–46 49 52–53 55 57 60 63–64 66–67 70 72–76 79–85 88–89 91–94 100–102 111–112 114–118 127–129 136 138 141 143–145 150 152 156–158 162–165 171 177 180–187 190–191 194–195 199–201 203–205 207–209 212–215 217 219 222–226 228 237 241–243 248–250 253 257 261 263–264 266–267 271 274 276 278–279 283–287 289 292–294 296–297 299–300 305–307 309 311–312 314–319 321 323–325 329–331 334–340 343–345 348 351–353 355 361 364 369 371 373–382 384 388 392–393 398–401 404–405 409–418 420–423 426–427 430 434–436 440 442–443 446–448 450 452 457–462 464–466 468–469 471–473 478 480 484 487–488 490 496 499–500 503 510–511 519–522 524–525 527–528 541–544 546–547 550 552–557 559–560 566 568–569 572 574–577 579–580 582–583 586 589 593 595 597–599 601 604 606 608–611 613–614 617–619 622–628 630 632 636 640–641 645 648–650 654 656 658 662 664 668–670 673 675–677 679 684 686–689 691–693 696 700 |

TABLE 1-continued

| TISSUE ORIGIN | RNA SOURCE | HYSEQ LIBRARY NAME | SEQ ID NOS: |
|---|---|---|---|
| | | | 706–711 715 717–719 723–725 735–736 741 746 748 752 757 759 761–764 766 770–772 774–782 784–785 797–801 803–814 816 820–822 824–827 831–834 837–847 849–852 856 858 861 864 866 869 872–877 880–884 888–889 893 895 900 902–905 911–912 915–916 919–921 924–925 931–932 934–953 956 959–961 966–967 969–971 974–976 982 984–985 989 995–999 1002 1004 1006–1009 1012 1014–1017 1020 1022 1024–1025 1029 1034–1036 1041 1044–1045 1047–1048 1055–1057 1059–1060 1063–1064 1066–1069 1071–1074 1076–1078 1082 1084 1086–1087 1090 1094–1098 1101 |
| adult brain | Clontech | ABR011 | 37–38 182 300 392 624 689–690 748 893 |
| adult brain | BioChain | ABR012 | 423 451 1061 |
| adult brain | BioChain | ABR013 | 37–38 66 171 272 369 374–376 515 530 757 1010 1104 |
| adult brain | Invitrogen | ABR014 | 30 37–38 48 128 137 415 544 626 670 762 952 960 1010 1094 |
| adult brain | Invitrogen | ABR015 | 93 108–109 115–116 447 473 670 1010 |
| adult brain | Invitrogen | ABR016 | 37–38 52 1010 1024–1025 |
| adult brain | Invitrogen | ABT004 | 9–11 19–20 22–23 29–30 35 44 52–53 55–56 64 66 69 72 74 82 102 112 133 135 150 156 164 176 181–183 190 201 206 233 238 274 279 284–286 301 330 334 349 351 353–354 369–371 377–378 392 395 398 405 416 423 427 434 437 450 462 464–465 473 488 499 511 515 522 526 542 554 559 579–580 612 624 636 641–643 647–648 650 655–656 675–676 687 692–693 704–707 709 724–725 740 742 775 779 798 802 804 809–810 8T2–813 825–826 829 833–836 840 856 859 863 877 882–883 894 914 919 921 944 948 952 970 975 999 1002 1024–1025 1031 1033–1034 1046–1047 1060 1068–1069 1073–1074 1094–1095 |
| adipocytes | Strategene | ADP001 | 4 9–11 52–53 64 73 102 104–105 184–186 194 199 202 224 233 237 279 295 297 299 309 315 325 352 363–364 392 415 432 466 477–478 502 519–521 528 530 543–544 564 567 578–580 621 647 669 673 682–683 687 689 692–693 695 713 715–716 720 727 733 760 767 786 788–791 825–826 829 908–909 918 950 961 987–988 1004 1010 1012 1019 1029 1035 1055–1056 1060–1061 1088 1099 |
| adrenal gland | Clontech | ADR002 | 9–11 15 22 24–25 27 45–46 56–58 64 73 84 89–90 98 100–101 105 108–111 113 119 128 135 147 151 157 165 167 171–172 177 190 193 202 210 221 224 227 248–249 257 264 272 277 279 285–287 297 305–306 308 315 323–324 348 352 361 385 393 396 398 403 416 418 428–430 442 457–462 473 501 514 522 530 533 554 560 568 583 589 599 609–610 617–618 629 635 639 652 654 656 663–664 668 677 679–680 688 691 694 737 742 744 748 760–761 765 801–802 804 810 816 823–824 840 847 852 864 870 877 898 907 913–914 916 921 933 960–961 964 970 975 980 983 997 |

TABLE 1-continued

| TISSUE ORIGIN | RNA SOURCE | HYSEQ LIBRARY NAME | SEQ ID NOS: |
|---|---|---|---|
| | | | 1014–1015 1017 1020 1032–1033 1035 1038 1055–1056 1059 1068–1069 1077 1088 1090 1096 |
| adult heart | GIBCO | AHR001 | 3 6 9–11 18 22 24–25 27 31 34 41 43 53 56–57 60–61 64 66 70 74 80 82–83 85–86 88–90 104–105 107–113 119–120 123 126 128–129 131 133 136 143 146–147 150–154 157–158 161–164 166–167 170–172 177 180 182 184–187 190 193–194 196–197 201 209 211–215 217 221 224 228 231 236–238 250–253 257–258 260 262–263 265 269 272 274 281–286 288–289 292–297 299–300 303 310 315 323–330 333 335–339 341–342 346–347 352–354 356–357 365–366 369 374–376 379 383 391 393 395 398–400 403–404 409–410 412 414–416 419 422–423 427–428 430 435 437 443 445 449 454–455 459–464 469 472–474 480 487 489 495 497 502 506 511 513 515 522 528 530–532 534–538 542–546 548–549 554 556 560 562–564 566 568 572 575–577 579–580 582–583 586 588 591–592 596–597 599–600 602 606 608–612 614–615 620–622 632 645 648–650 654 656–659 662 664–665 667–673 677 679 686–689 692–695 698 704 707–708 710–711 713 716–725 727–728 731 735 738 743–744 746 748 752–753 756–757 759 761 764–765 772 774–776 778 782–783 793 795 797–798 802 805–806 808 810 813 815 817 820–823 833–834 837–838 840 847 856 858–859 864 866 881 885 888–889 891 895–897 900 905 907 911 916–919 922–925 928–931 933–934 937–938 940 943–944 946–948 951 958 960–961 967 970–972 977 982 988–989 996 998 1007–1011 1014–1015 1020 1022 1024–1027 1029 1034–1035 1039–1040 1044–1046 1049–1050 1055–1056 1059 1061 1064–1065 1068–1070 1073–1074 1079 1087 1090 1094 1100 |
| adult kidney | GIBCO | AKD001 | 2–4 6 14 17 21–23 25 29 31–32 35 37–38 41 43–45 47 49–50 53–55 65 68 71 73–74 78 81–83 88–89 97–98 104–111 117–118 120 123 125 127–129 133 135–136 138 141 143 145–148 150–151 154–155 157 161–162 164–165 167 171–179 184–187 190–194 197 199 201–204 209 212–215 219 222 224 229–230 232 236 238 240 243 247–252 254 258 262–265 268–269 275–276 278 281–283 285–290 292–296 298–303 310–312 315–321 323–330 333–334 339–340 343–345 351–354 358 360–361 370 374–377 380 384 393–394 396 400–401 403–404 411 415 419–420 422 427 429–430 435 437 439 446–447 449 455–457 459–462 464 470 472 477 479–481 485 488 490 493 495–497 499–504 506 511 514 517 519–523 527–530 533–540 542–546 549–550 552 554 556 559 561–568 571–572 574–576 578–581 583–585 587 591–593 595–597 599–601 605 607 609 612–614 616–622 624 627–629 632 635–636 638 640–645 647–648 650–651 656–657 659 663–665 |

TABLE 1-continued

| TISSUE ORIGIN | RNA SOURCE | HYSEQ LIBRARY NAME | SEQ ID NOS: |
|---|---|---|---|
| | | | 669–673 675–677 679–680 682–684 686–689 691–696 698 700–701 704–705 707–708 710 713–719 723 726–728 730 732 735 738 742–744 746–753 757 759–762 767 774–775 777–778 781 783 786 788–791 796 798–801 805–808 810 812–814 821–824 829 831–832 835–836 838–839 842–843 846 846 852 856 859 867–868 870 872 881 885–889 891–893 895–900 905–908 910–911 914 916–917 919–920 922–924 928–931 933–934 936–937 943 947–948 950–951 957–958 960 962–964 971 973 977–979 983–985 989 996 998 1001–1003 1007–1010 1013 1019–1020 1024–1025 1029 1031 1039–1040 1043–1047 1049 1057 1059 1063 1065 1068–1069 1084 1087 1090 1094 1096 1098–1100 |
| adult kidney | Invitrogen | AKT002 | 12 14 17–18 22 31 43–45 49 55–56 60 65 74 88 90 95 104 117 119 123 127–128 146 161–162 178 180 187 190 193 197 203 211–215 221 229 261 263 270 275 279 284 293–294 303–304 307 314 321 333 343–345 377 391 405 419 427 445 452 459–461 472 480 489 499 512 522–523 534–535 537–538 554–555 566 575–577 583 588 590–592 601 606 612 614 621 628 636 639 644 647 649 655 657 687 696 717–718 732 740 744 752 756–757 762 774 788–791 796 799–800 802 804 808 815 823 825–826 835–837 842 848 881 885 888 922–923 931 946 954 962–963 971 975 983–984 989 1002 1010 1014–1015 1020 1034 1039 1041 1045–1046 1059 1068–1069 1094 |
| adult lung | GIBCO | ALG001 | 5 18 24 35 44 54–55 67 82–83 105 110 119 128 133 135 141 143 145 150–151 162 178 187 202 212–215 219 222–223 229 240 259 284 293–294 298 300–301 312 323–324 333 343–345 352 377 393 399 403 427–428 447 450 458 473 488 496 499 502 516–517 522–523 530 537–538 543–544 546 551 565 572 586 590 628 641–644 653 658 664 666 668 674 677 679 683 688 692–693 702 705 733 735 743 748 751 753 761 769 775–778 783 796 815 823 825–826 831 839 846 862 879 889 897 909 931 962–963 970 972 985 996 1010 1021–1022 1043 1064 1069 1073–1074 1095 1100 |
| lymph node | Clontech | ALN001 | 2 16 55 77 95 104 107 119 125 135–136 149 155–156 177 201 204 212–215 221–222 298 303 327 333 361 403 409–410 422 477 481 488 516 519–521 523 529 542–543 551 564 590 600 615 650 663 692–693 700 726 738 805–806 840 888 893 915 933 955 964 1014–1015 1029 1043 1064 1067 |
| young liver | GIBCO | ALV001 | 15 24 29 32 35 45 47 65 67 71 74 81–82 84 88 105 118 129 133 150 152 157 167 184–186 190 194 197 201 211 224 247 250–253 261 268 278–279 284 298–301 305–306 308 310–311 315 326 339 347 349 360 379–380 382 401 403 412 414 418 422 428–429 450 454 457 463 472 485 493 497 499 526 534–536 |

TABLE 1-continued

| TISSUE ORIGIN | RNA SOURCE | HYSEQ LIBRARY NAME | SEQ ID NOS: |
|---|---|---|---|
| | | | 556 559 564 572 578 583–585 587–589 591–592 596–597 606 609 611 621 640 644 650 652 657 671 673 684 688 691 695 700 717–718 721–722 740 750 755 759 765 775 778 782 788–791 799–801 805–806 808 810 814 825–826 833–834 845–846 848 885 888–889 898 900 908–909 931 934 952 960 965 969 973 985 1007–1010 1022 1029 1034 1049 1052–1053 1069 1073–1074 1094 |
| adult liver | Invitrogen | ALV002 | 6 29 32 47 49 71 74 82 88 102 104 107–109 128 150 168 177–179 191–192 203 209 219 227 237–239 243 254 257 285–286 308 310 315 322 328 333 340 346 354 384 389 392 405–406 434 437 462 466 478 499 505 511 519–522 532 534–535 543 546 559 564 578 583 589 596 605 608–609 613 633 635 659 665 673 683 694 708 715 719 722 741 752 757 759 762 775 778 782 786 802 808 845 848 884 887–888 897 909 916 931 951 962–963 967 975 998 1005 1010 1014–1015 1020 1052–1053 1065 1094 1099–1100 |
| adult liver | Clontech | ALV003 | 358 684 752 808 |
| adult ovary | Invitrogen | AOV001 | 3 5–6 8–11 14 17 22 25–26 29 31 33 35 43–45 49–50 52–57 60 63–65 67 70–71 73 76 82–84 86 88–90 97–98 100–101 104–109 113 117–120 122–123 125 127–129 136–137 142–145 147 150–153 155–158 161 163–168 170–171 173–175 177–179 183–188 190–191 193–195 197 199 201 203–209 216–219 221–222 224 227 229–231 237–240 242–243 245–246 248–249 251–252 255 257 259 261–264 266–267 269 272 274 276 278–282 284–290 292 295–299 301–304 307–308 310–311 314–318 320 322–325 327–330 332–334 336–346 348–357 359–360 363 365–366 374–377 379–393 397–405 407 409–411 413 416 418–419 427–430 434–435 437 442 447 449 451 456–457 459–462 464 467–468 470 472 474–475 478–480 485 488 490 494–496 498–500 503–504 506–509 511 513–514 516–517 522–523 528–535 537–542 544–549 552 554 556–557 559–560 563–568 572–573 575–580 583–595 597–601 603 606–609 611 613–614 616–626 628 630–633 635–638 640 642–645 648–651 653–654 657–666 668–669 672–673 675–677 679 682–684 686–688 691–697 699–701 704 707–708 712–713 717–719 721–723 725 727 729–735 738–739 742–749 751–753 756–759 761–762 764–765 767–768 774–775 778–779 783–785 787–792 795–797 801–806 808–809 812–816 820–824 831–832 835–838 842 845 847 852 854–855 858–860 862–864 866–867 869 872–874 879–880 884 886–889 891 894–903 906–908 910–915 922–925 928–931 933–934 937 939 942–944 946–948 952 955 957–958 960 965 968 970–973 976–979 981 983–984 988–989 996 998 1002 1007–1011 1013 1017 1019–1020 1022–1023 1028–1029 1031 1033–1041 1046 |

TABLE 1-continued

| TISSUE ORIGIN | RNA SOURCE | HYSEQ LIBRARY NAME | SEQ ID NOS: |
|---|---|---|---|
| | | | 1049 1051 1055–1056 1061–1065 1067–1069 1073–1074 1076 1079 1084 1090 1095 |
| adult placenta | Clontech | APL001 | 24 88 150 177 220 250 301 314 403 439 457 545 575–576 611 634 642–643 649 677 679 689 733 742 891 1010 1059 |
| adult placenta | Invitrogen | APL002 | 2 7 12 32 52–53 91 97 104 108–109 122 128 157 164–165 191 197 309 407 409–410 412 422 430 453 503 528 539–540 542–543 603 635 640–641 663 675–676 692–693 701 721 724 753 757759 775 828 833–834 849 967 975 1007–1010 1033 1035 |
| adult spleen | GIBCO | ASP001 | 6 14 22 31 45 55 59–60 67 77 80 88 105 108–110 120 122 125 147 155 164–167 174 177 179 191 193 205 209 211–215 222 229 233 250–252 258 268 272 281 288–289 297–298 300 309–310 320 330 333 338 340 349 353 355–357 366 382 393 405 412 414 416 422 426–428 430 446 449 458 464 472–473 478 495–496 502 507 515 517 530 533 537–538 543 547 551 559 564 567 569 591–593 599 606 608–610 613–614 621 629 636 644–645 650 664–665 670 677 679–681 683–684 686 692–693 695 698 700 719 724 730–732 734 737 748 757 759 765 778–779 783 792 798 802 804 813 829 852 859 863 866 879 885 908–909 915–916 919 926 931 936 948 959 961 964 985 991 1010 1012 1020 1024–1025 1029 1039 1041 1043 1049–1050 1054 1059 1064 1076 1087 1104 |
| adult testis | GIBCO | ATS001 | 3 7 22 43–45 65 71 84 89 100–101 104–105 107 111 120 128 135 143 147 151 155–156 167 173 176–177 187 197 201 222 227–228 239–240 248–249 251–252 257–258 261 276–279 262 289 292–294 297 307 309 315 325 327–328 333 335 339 346 352 356–357 395 403–405 407 412 415 422 428 430 457 464 468 472–473 487 489 494 496 499 511 516 522 528 530 533 544 551 554 562 590 597 600 603 606 608 613 616 624 637 647 650 658 662 664 668 677 679–680 695 704 717–718 722–723 726–727 733 748–749 753 759 761–762 776 778 786 788–791 793 797 802 830 838 850–851 864 897–898 911 916 919 921 925 928–929 933 943 975 977–979 981–983 997 1001 1007–1010 1020 1022 1028 1035 1059 1063–1064 1069 1079 1089–1090 1100 |
| Genomic DNA from BAC 63I18 | Research Genetics (CITB BAC Library) | BAC001 | 368 1042 1103 |
| Genomic DNA from BAC 393I6 | Research Genetics (CITB BAC Library) | BAC002 | 1102–1103 |
| Genomic DNA from BAC 393I6 | Research Genetics (CITB BAC Library) | BAC003 | 1042 |
| adult bladder | Invitrogen | BLD001 | 21 36 55 87 89 98 104 117 157 176 217–218 238 240 284 293–294 303 313 330 349 353 392 411 |

TABLE 1-continued

| TISSUE ORIGIN | RNA SOURCE | HYSEQ LIBRARY NAME | SEQ ID NOS: |
|---|---|---|---|
| | | | 439–440 446 457 470 472 522 525 551 578 583 594 605 616 653 664 670 704 713 744 762 771 829 856 874 878 888 960 1059 |
| bone marrow | Clontech | BMD001 | 3 6 12 16 25 30–31 43–44 55 57–58 60 62 67 77 82 84 86 90 95 98–101 103–105 110–111 113 115–116 119 121 128–130 135–136 145–146 149 151–153 155–156 159 162 167 172 174 177–180 187 190 193 198–199 201 205 210–215 217 219–220 224 230–231 241 243 245–253 257 259–262 264 269 271 278 280–281 285–286 290–296 298–299 307 310–311 314–315 320 327–328 333 335–339 347 352 354 356–357 361 365 383 390 393 399–400 402–404 415 419–420 424–426 428–429 436 445 449 456–457 459–462 464 469–470 473–475 480 –483 487 495–497 508–509 511 515 517–518 522–523 528–529 533–540 543–544 551–552 554 563–565 566 575–577 581 588 590 593 598–601 609–611 614 617–618 624 626–628 639–640 642–645 650 656 660 663 668 672 674 677 679 682 687 689 692–693 695 701 704 713 716–719 721 723 725 727 730 732 735 738 741–743 748 750 752 755 759–760 768 795 799–802 804–806 813 815 823–824 831 833–834 852 861 867 886 888–889 891 905–906 913 916–918 930 936 944 951 956 960 968 971 975 977 980–981 983 989–991 998 1004 1007–1010 1017 1021 1029 1033 1036 1039 1043 1046 1051 1057 1059 1062–1064 1069–1070 1084 1090 1093–1094 1097 1099 1104 |
| bone marrow | Clontech | BMD002 | 3 7–8 21 25–26 30 33 43–46 57 59–60 70 76–78 88–90 95 99–101 103–104 107–110 114 118 125 128 139–140 146 149 152 165 167 190 194 198 200 206 220 223 227 242 245–246 257 259 266–267 271 274–275 278 293–294 298 319 328 330 335 338 353 356–357 361 366 392 402–403 412 418 421–422 426 445 449 458–462 474 496 499 503 515 519–521 539–540 544 551 554 556 563–564 569 574 577 589 609–610 619 677 679 685 688 691 704 724 730 736 739 743–744 747 777–778 795 801–803 844 846 881 889 912 916–917 926–927 950–951 972–973 975 977 985 1004 1007–1011 1014–1017 1020 1023 1031 1033 1037 1040 1043 1045–1047 1057 1059–1060 1063 1067 1069 1071 1073–1074 1084 1087 1090 1097 1104 |
| bone marrow | Clontech | BMD004 | 177 609 724 |
| bone marrow | Clontech | BMD007 | 551 1010 |
| adult colon | Invitrogen | CLN001 | 6 32 59 61 67 82 94 129 155 159 177 184–186 266–267 292 313 325–326 346 354 366 379 392 409–410 427 464 470 472 511–512 533–535 539–540 543 551 557 583 605 608–610 640 663 670 680 692–693 705 708 713 715 743–744 752 757–758 829 842 859 874 885 888 909 970 1004–1005 1010 1035 1041 1045 1059 |
| Mixture of 16 | Various | CTL016 | 74 |

TABLE 1-continued

| TISSUE ORIGIN | RNA SOURCE | HYSEQ LIBRARY NAME | SEQ ID NOS: |
|---|---|---|---|
| tissues-mRNAs* | Vendors* | | |
| Mixture of 16 tissues-mRNAs* | Various Vendors* | CTL021 | 466 821–822 1094 |
| adult cervix | BioChain | CVX001 | 2–3 5 8 15 25 31 35 44–45 49 52 54–55 57 61 71 73 84 88 90 93–94 100–101 104–105 107–110 113 120 122 135–136 138 145–151 153 156–157 165 167 170 177 180 184–187 190–191 201 205 210 217–219 221–222 233 237 248–249 251–253 257–258 261–262 264–265 269–270 277 279 281–282 284–286 289 292–296 300 322 328 332–333 336–337 343–346 352 354 362 365 373–376 380 388 390–391 393–394 396 404–405 411 413 415–416 421 429–431 437–438 444 449 458–461 464 474 477 480–481 483 485 488 490 503 511 513 516–517 519–521 528 532–533 536–540 542–545 549–551 554 556 561 563–565 567 572 575–576 582 584–587 590–593 598–600 603 605–606 609 614 619 621–625 631 635 642–643 645 650–651 654 656–657 659 663 665–666 670 672 677 679 687 692–695 704–705 712 715 721 724 726 733 735 741 743–745 755–756 760 762 764 768 771 787 802 813 818 823 828 835–838 852 856 859 862 864 866 870 886 889 891 900 903 905 910–911 914 916 922–924 930–931 933 948 954–955 958 960 969 977–980 998 1000–1001 1006 1010 1013 1017 1035 1039 1043–1044 1050 1062–1064 1073–1074 1076 1084 1087 1096–1097 |
| diaphragm | BioChain | DIA002 | 414 464 673 1100 |
| endothelial cells | Strategene | EDT001 | 2 4–6 8 13 15 24–28 33 44 48 53–55 57 60 63 65 70 73 81–82 84 86 88 90 99–101 105 108–110 113 115–119 123 128 137–138 146–149 151–153 160 162–164 171–172 174–178 184–187 190–193 197 199 201–203 207–209 211–215 217–221 223 237–239 242–243 248–252 255 257 261–262 265 269 272 274 276 280 284–289 292–294 297 299 303 308 310–312 316–319 322 325 333 335–339 341–345 352 355 360 362–364 374–379 389 391–392 395–396 403 414 416 418 420 422 427–430 435 443 452 455 457 459–462 467 470–473 477 485 488 490–492 495–496 499 501–503 506–507 509 511 513–514 517 519–523 527–530 533–535 539–545 547 549 554 556 559 561–564 568 570 572 575–576 579–580 583–585 588 593 595–596 599–600 603 606–609 611 613–615 617–622 626 630 635–636 638–641 644 646–648 651 656–657 660 662–665 670–671 675–677 679–680 683–664 687 689 691–701 704–708 710–713 716 719 721–722 726–734 738 744–745 748–749 751–753 756–759 761–763 765 767 771 775–776 778–779 782–786 788–792 796 798–802 805–806 813–815 817–820 823–824 827 829 833–834 837–838 842 846 849 852 860 872–873 887–888 891 894–896 900 905–906 908 910 914 918–919 922–925 928–931 933–934 |

TABLE 1-continued

| TISSUE ORIGIN | RNA SOURCE | HYSEQ LIBRARY NAME | SEQ ID NOS: |
|---|---|---|---|
| | | | 936 940 943 947–948 951 955–956 958 960–961 964–967 970–973 975–976 978–980 983 985 988 998 1002 1007–1010 1014–1015 1017 1019–1020 1024–1025 1028 1032–1033 1035–1037 1040 1045–1046 1049 1057 1059 1064 1066 1069 1088 1090 1097 1099 |
| Genomic clones from the short arm of chromosome 8 | DNA from Genetic Research | EPM001 | 368 987 993–994 1042 1102–1103 |
| esophagus | BioChain | ESO002 | 53 177 545 577 687 695 1087 |
| fetal brain | Clontech | FBR001 | 9–11 52 64 85 155 221 239 284 361 392 552 700 719 744 918 941 952 1010 1098 |
| fetal brain | Clontech | FBR004 | 4 35 47 76 110 288 323–324 338 350 352 373 469 490 530 852 898 905 922–923 928–929 1077 1101 |
| fetal brain | Clontech | FBR006 | 3 6–7 9–11 19–20 25 30 43 46 50 52–53 55 57 64–65 70 72 75 80–82 84–85 91 95 98 100–101 104 110–111 114–117 128 134 138 141 147 150 157 162–163 169 171 182 184–187 190 193–194 199 205 212–215 219 222 225 237 243 248–250 258 266–267 272 274 281 284–286 292 300 305–306 309 312 316–318 334 336–337 339 346 351 356–357 361 371 373–376 378–379 381 383 388 392 399 404 412 416 418 420 426–428 441–444 447 459–462 464 484 491–492 495 502–503 511 524 528 543 546 549 556–557 569 575–576 579–580 583 589 597 602 608–610 622–623 625 632 637 639 642–643 645–646 648 650 654 656–658 677 679 686 688 692–694 696 701 704 710 712 717–718 720 723 730 735–736 740 745 754 756 759 771 778 798 803–804 808 820 832–838 840 842–845 849 852 856 861–862 867 873 875 877 879–889 900 905 911–912 915–916 919 921 926 935 943–945 948 950 952 956 960–963 971 977 998–999 1004 1007–1010 1016 1024–1025 1029 1031 1034 1040 1046 1059–1061 1063 1066 1069 1071–1072 1076 1082 1086–1088 |
| fetal brain | Clontech | FBRS03 | 194 549 757 877 |
| fetal brain | Invitrogen | FBT002 | 2 7 12 19–20 23 30–32 54–56 63 81 92–93 104 108–109 112 117–118 135 138–140 157 164 168 183 190 193 197 202 233 237–238 248–249 266–267 272 274 300 310 325–326 328 334 351–352 354 364 372–373 382–383 392 401 420 430 466 468 472–473 499–500 510 514 525–526 532 539–540 542–543 582–585 589 606 612 622–624 633 635–636 641 647–649 653 656–657 673 683 687–688 692–693 695 700 702 710–716 733 740 744 757 759 761 767 771 774 779 798 804 807 809 817 825–826 833–834 838 845–846 882–884 887 893–894 909 911 924 947 952 961 964–965 970 975–976 984 1002 1004 1007–1010 1020 1032 1034–1035 1039–1040 1045–1046 1048 1054 1059 1069 1073 –1074 |
| fetal heart | Invitrogen | FHR001 | 549 724 837 919 |
| fetal kidney | Clontech | FKD001 | 3 44 60 65 68 76 96–97 105 110 117 129 143 174 193 197 217 239 |

TABLE 1-continued

| TISSUE ORIGIN | RNA SOURCE | HYSEQ LIBRARY NAME | SEQ ID NOS: |
|---|---|---|---|
| | | | 248–249 261 277 296 300 328 332–333 336–337 339 361 403 415 464 483 506 518 529 539–540 542 549 553 563 596 616 645 647 656 677 679 695 734 776 792 818 828 975 1002 1021 1045 1059 1061 1066 1081 1093 |
| fetal kidney | Clontech | FKD002 | 25 57 100–101 114 259 279 749 820 1014–1015 |
| fetal kidney | Invitrogen | FKD007 | 8 361 675–676 687 916 920 1010 |
| fetal lung | Clontech | FLG001 | 44 71 100–101 119 147 224 236 281 293–294 303 309 327 329 393 400 403 430 470–471 517 527 534–535 549 579–580 764 867 871 889 895 918 999 1001 1035 |
| fetal lung | Invitrogen | FLG003 | 6 17–18 25 46 49 52 57 82 100– 101 104 106 141–142 149 157 162 167 190 206 210 220 222 224 240 258 279 300 322 339 343–345 352 355 393 400 409–410 412 445 450–451 458 490 515 537–538 549 560 608 619 624 633 636 650 675–676 702 704–705 712 715 779 786 859 874 889 904–905 913 948 980 999 1010 1032 1037 1045 1059 1071 1104 |
| fetal lung | Clontech | FLG004 | 7 139–140 421 528 820 |
| fetal liver-spleen | Soares | FLS001 | 2–5 15 17–18 23 25–26 29–31 33 35 43–47 49 51–57 59–60 63 65– 66 73–74 76 80 82 84–86 89 91 93 96–111 113–116 118–119 122 126–128 130 133 135–144 146–153 155–157 161–162 164–165 167 174–175 177–180 183–187 189–194 197–199 201–204 206 209 211–215 217 222–224 228–229 237–238 240 243–244 247–252 255 257 259 261–274 276–282 284 287–290 292–298 300–301 303 305–312 314–318 322 325–328 333–339 341–342 346 348 351–352 354 356–357 360 363–364 366 372–377 379 384 390–393 396–397 399–403 409–412 414–415 418 420 422 424–425 427–430 432 434–435 443–450 452 456 458–461 463 467–472 477 480–481 483 485–490 493 495–497 499 503–504 506–509 511–517 519–522 528–532 534–552 554–561 563–568 572 574–580 582–583 587 589–596 599–601 603 606 608–615 617–624 626 632–637 640–645 647–648 650–652 654 656 658 661–665 667–670 673 675–677 679–680 682–684 687–689 691–696 700 702 704–707 713–714 716–719 721 723–724 727–732 735 737–738 741 743–745 747–748 750–753 756–759 761–763 765 767 771 774–776 778–779 786 788–792 796–802 804–808 810–812 814 816–817 820–823 825–826 833–839 842 848–849 852 859 864 866–867 877 879–881 884–889 891 895 897–900 903 905 907 910–911 914 916 918 924 927 931 934 936–937 941 944 948 951 956 958 960–963 967–972 974–975 977–980 984 989–990 996–998 1003–1010 1014– 1015 1017 1020 1022–1023 1028 1031 1033 1035–1037 1039–1040 1043–1050 1052–1053 1055–1057 1059–1060 1062–1064 1066 1068– 1071 1073–1074 1076 1079–1081 1090 1092 1094 1096–1101 1104 |
| normalized | Soares | FLS002 | 2 4 7 15 21–22 25–26 29 32 41 |

TABLE 1-continued

| TISSUE ORIGIN | RNA SOURCE | HYSEQ LIBRARY NAME | SEQ ID NOS: |
|---|---|---|---|
| fetal liver-spleen | | | 44 47 49–52 54–57 59–60 65–66 70–71 73–74 76 84–87 95 97 100–101 103–104 107–110 112 114 117 119 122 125–126 128–129 134–137 139–141 143 145–147 149–150 152–153 155–157 161 164–165 167–168 171 174–175 177–179 183–187 189–191 193–194 199 201–206 209 212–217 219 222 227–229 231–232 234 237–238 240–243 247–253 259–263 266–267 269 271–272 274 278 281–283 285–290 293–294 296–301 303–310 312 315–320 322 325 327–330 332 334–338 341–346 348 351–354 356–357 363–364 367 370 372 378 380 382–385 389 391–393 396 400–401 403–405 407–408 412 415–416 418 421–422 426–429 432 436 438 443 447–450 452 454 457–461 464 466 468 470 475 479–483 486–487 490 493 496–497 503 508–509 511–512 517 519–522 524 528 531 533–541 543–546 550 552 554 556 558–559 561 563 566–567 572 574 577 579–583 586–587 589 591–593 597 600–602 606 608–611 613–619 621–622 624 626–628 630 633–634 637 640 645 648 652–654 658 660–662 664–666 668 671–672 677 679–680 682–684 686 688 691–693 695 697–699 701 704 708 711 713 715–719 721–723 727–730 732–733 737 741 744–745 747–748 751 753–754 756–759 761–763 768 771 776 778 782 786 788–792 794–796 798–803 812 814–816 821–823 829 832–834 837–839 845 847 849 852 861–862 866–867 870–873 879–881 884–886 888 893 895 897 900 903 905 908 916 918 920 924–925 927 930–931 933 935 937 946 948 950–951 954 958 960–961 965 968–969 974–976 978–979 989–991 996 998 1002 1004 1007–1009 1013–1015 1017–1020 1024–1025 1029 1033–1037 1039–1040 1044–1045 1047 1050 1052–1053 1055–1057 1059 1062 1066 1068–1070 1076 1079–1081 1084 1090 1094 1097 1100 |
| fetal liver-spleen | Soares | FLS003 | 25 45 52 54 57 65–66 76 96 98 103 108–109 114 118 127 177 189 219 268 665 753 1014–1015 1017 1023 1047 1059 1068 |
| fetal liver | Invitrogen | FLV001 | 2 17 29 44 47 49 52–55 68 82 86 88 93 103 108–109 115–116 139–140 164 168 178–180 183 197 202 209 227–228 231 238 243 245–246 248–250 284 309 336–337 349 351 354 367–368 384 401 409–410 416 432 443 445 462 468 470 494 502 514 522 542 546 557–558 560 566 574 579–580 594 596 603 641 650 654 661 664 673 675–676 680 682 684 687 692–693 696 702–703 708 730–731 759 775–776 778–779 807–808 811 833–834 837 842 846 848 872 884–885 916 940 947–948 952 957 970 975 997 1002 1004 1007–1010 1034–1035 1039–1040 1045 1052–1053 1094 1096 |
| fetal liver | Clontech | FLV002 | 358 685 |
| fetal liver | Clontech | FLV004 | 28 47 52 230 257 278 361 522 532 544 812 926 960 1003 1014–1015 1017 1045 1057 |

TABLE 1-continued

| TISSUE ORIGIN | RNA SOURCE | HYSEQ LIBRARY NAME | SEQ ID NOS: |
|---|---|---|---|
| fetal muscle | Invitrogen | FMS001 | 32 34 49 52 56 71 86–87 93 104 110 122 126 136–137 147 151 177 193 204 237 245–246 266–267 274 284 300 303 313 325 339 354 398 409–410 414 417 445 459–461 472 511 522 545 559 600 602 608 622 657 667 673 675–677 679 687–688 695 702 715 723–724 733 749 753 759 772 786 788–791 805–806 810 853 862 887 897 917 930 948 956 960 967 988 1007–1010 1014–1015 1019 1026–1027 1059 1073–1074 1089–1090 1094 1100 |
| fetal muscle | Invitrogen | FMS002 | 75 100–101 137 222 276 420 554 687 721 772 956 |
| fetal skin | Invitrogen | FSK001 | 1 3 6–8 12 14 18 24–25 28–29 31–32 35 41 43 45 49 52–55 57 61 67 78–79 82–83 85–86 93–94 98 100–101 110 115–116 119 122– 123 128 136 139–140 146 150 164 167 178 180 183 189–191 193 195 201 206 212–215 222 224 231 236–237 243 248–249 257 260 265 271 288–289 292 300 308–309 313 325 327 329 336–337 339 343–346 349 351 354 358 360 363 370 383 386–367 391–392 396 400–401 404–405 409–410 412–413 416 432 434 437 443 448 450 454 459–461 464–465 470 472–473 483 494 496 499 501–502 507 509–511 516 527 542 544 546 548–549 566 579–580 593 595–596 603 605 609–610 615 619–620 622 624 633 635–636 640 647–648 653–654 657 662 664 673 677 679–680 686–687 691 695 701 706 713 715 720 723 729–731 743 746–747 749 751–753 758 761 766 779–780 786 788–792 797 802 808 812 817 820 823 829 837–838 841–842 845 852 856 867 871 878 881 884–885 887 890–894 897 900–901 905 908–909 911 914 918 930 933 948 956–957 964 967 970 972–975 989 1000 1007–1012 1014–1015 1019–1020 1032 1034 1036 1039–1041 1044–1047 1055– 1056 1059 1061 1063 1066 1068 1070 1073–1074 1077 1089–1090 1096 1101 |
| fetal skin | Invitrogen | FSK002 | 3 8 12 14 27 43 45 58 73 75 82 88 100–101 107 110 124 128 189 219 261 275 451 495 530 626 765 798 844 1007–1010 1016 1023– 1025 1033 1037 1040 1059–1061 1067–1068 1081 1087 |
| fetal spleen | BioChain | FSP001 | 26 265 598 614 797 |
| umbilical cord | BioChain | FUC001 | 6–8 18 24 29 41 44–46 52–53 59 63 65 67 77 80 82–84 86 88 90 94 98 101 104–110 112 118–120 128 133 135 137 141 147 156–157 160 162 164 169 178 183 199 201 212–215 222 230–231 237 250–253 264–267 269 283 292 297–298 310 315 323–325 328 338–339 343–345 349–350 356–357 366 369 378 380 383 385–387 391 394 397 403–404 409–411 416 433–434 446 449 455 459–461 464 473–475 477 480 487–488 499–502 507 518 528 530 533 543 546 549 560 564 573 579–580 582–585 588 591–592 596 599 612 617–620 623 627 635 640 647 653 664 671 677 679 685 687–688 692–693 695 704 711 713 725 734–735 748 750–752 762 |

TABLE 1-continued

| TISSUE ORIGIN | RNA SOURCE | HYSEQ LIBRARY NAME | SEQ ID NOS: |
|---|---|---|---|
| | | | 765–766 778 783–786 801–802 804 823 833–837 840 843 845 852 860 886 893–894 897 905 907 913 924–925 933–934 936 969 973 976–977 988 1006 1010 1034 1036 1040 1047 1049 1061 1063 1065 1071 1088 1090 1094 1099 |
| fetal brain | GIBCO | HFB001 | 3–4 12 14 19–22 25 27 29–32 35 37–38 44–45 50 52–53 55 57 60 63 73 82 88–90 93 98 105 108– 109 112 115–117 123 125 127–129 131–137 144 146–147 149 151–152 156–157 160–162 164–165 167 170 173–174 176–178 180–181 183–186 190 193–194 197 200–201 204–205 212–215 218–219 221–222 231 242–243 245–246 248–258 261 264 266–267 269 272 276 278 281 283–286 288–289 291–297 299–301 308 310 314 321 323–325 328–330 332–333 338 340 346 349–350 352–354 358 360 363 369 371 374–376 379 381 392–393 397 401 405 411 413–416 418 420 422 427–430 434–435 443 447 450 454 456 459–461 468 473 475 480 484 487–490 495–496 499 504–506 509 511 515 519–522 524–535 539–541 543–545 547 549 554 556 561–562 564 568 571–572 575–576 578–580 583–586 590 593–595 597 599–603 606 609–610 612 614 617–620 622–625 635 639–647 650–651 654 656–659 662 665–666 668 670 673–674 677 679 682 684 686–689 692–697 699–701 704 706–707 711 714 717–719 721–723 726 729 735 738 741–742 746 748 753 757 759 761–762 767–768 770–771 775 778 783 786 792 796–798 802–804 810–811 816 823–824 827 829 832 837–840 842 845–846 848 856 859 864 882–883 889 891 896–898 900 905 908–909 915–916 919 922–924 930–931 933 936 939–941 943–944 946 957–958 961 966 969 972 975–979 983–984 995 997–998 1002 1006 1010 1017 1028–1029 1031–1034 1036 1039 1045–1047 1049 1055–1056 1059–1060 1063– 1065 1069 1076 1079 1084 1088 1100 1104 |
| macrophage | Invitrogen | HMP001 | 177 312 360 544 563 620 675–676 1069 |
| infant brain | Soares | IB2002 | 3–4 6–7 12 19–20 22 25 29–30 35 44–45 50 52–53 56–57 65 70 74 80 82 85 87–88 90 92–93 96 102 104–105 108–109 112 117 123 127–128 135 138–140 143–144 146–147 149–150 152 156–157 161 164 166 168 171 177 181–182 184–187 190 193–194 199–201 205–209 211–215 222 225–226 237 239–240 242–243 248–252 255 257–258 260–263 266–267 269 272–274 284–286 288–290 293–294 297 299–301 304 309 315 319 323–325 328–334 336–337 339–340 343–346 348–357 371 373 377 379 381 385 389 396–398 401 405 412–415 417–420 423 427 429 435 439 443 447 453–454 456 462 464–465 469 472–473 477–478 484 488 493 496 499 510–511 515 519–521 525–528 530 533–535 539–540 545 547 549–550 555 557 |

TABLE 1-continued

| TISSUE ORIGIN | RNA SOURCE | HYSEQ LIBRARY NAME | SEQ ID NOS: |
|---|---|---|---|
| | | | 560–561 563 571 573 575–576 579–581 583 588–589 597 603–604 606 609–612 614–615 617–619 621–623 625 628 632–633 635–637 640–641 646–649 653–656 664 666 668 673–677 679 684 686–687 691–694 702 704 706–707 712–713 721 724 735 739–740 743–744 746–748 752–753 757–759 762 770–771 774 778 797–802 807–809 812–813 819 821–827 829 838 840 842–843 852–859 861 863–864 872–873 877 879 882–883 885–886 888 893 897–898 900 907–911 915–916 919 921 924 931 937 939 941 946 948 951–952 959 964 969 971 973 975 977–979 984–985 995 997 1003–1004 1006–1010 1019 1022 1031–1032 1035 1039 1046 1052–1053 1055–1056 1058–1060 1064 1071 1073–1074 1078 1090 1094 1097–1098 1104 |
| infant brain | Soares | IB2003 | 4 7 12 19–20 22–23 25 30 44 49– 50 55 57 76 82–83 88–89 127–129 146 150 152–153 164 177 181 190 194 205 209 211–215 226 239 248–252 261 263 266–267 269 272–273 278 283 289 293–294 297 299–301 328 330–331 340 346 348 352–353 356–357 360 371 398 401 411–412 414 418 443 459–461 464–465 469 480491–492 496 509 530–531 549 554 560 567 574 579–580 583 589 597 604 606 608–610 619 622–623 633 637 641 649 664 666 684 686–687 692–693 697 699 705 712 721 725 731 744 746 798 803–804 809 812 816 833–834 838 840–842 849 856 859 863 882–883 885 888 891 895 898 909–910 915 918–919 930–931 941 948 974 978–979 995 1004 1017 1023 1034 1037 1040 1046–1047 1055–1056 1068–1069 1078 1090 1094 |
| infant brain | Soares | IBM002 | 47 50 226 239 285–286 331 338 348 499 641 692–693 717–718 819 853 898 948 984 995 1010 1017 1087 |
| infant brain | Soares | IBS001 | 7 44 120 226 239 300 330 349 351 353–354 504 636 653 802 819 840 877 882–883 885 919 948 955 961 977 1007–1009 1014–1015 1032 |
| lung fibroblast | Strategene | LFB001 | 6 29 43 101 104 110 120 136 146 167 172 177 190 193 202 210 212–215 217–219 238 241 243 262 276–277 284 292 308 325 343–345 374–376 395 403 429 432 459–461 478–480 495 522 528–532 534 539–541 554 561 588 621 640 642–643 651 662–663 671 687 692–693 695 712–713 721 727 741 753 759 761 771 801–802 823 825–827 829 884 912 918 922–923 936 969 975 985 1001 1010 1024– 1025 1033 |
| lung tumor | Invitrogen | LGT002 | 2 5 14–15 17–18 21 25 31–33 36 41 43–44 49 53–54 57 62–63 71 73 77 83 88 97 100–101 104 106– 110 117–118 124–125 128 136 142 146–151 154–157 161–162 164–165 167 170–172 174 177–180 183–186 189–190 193 196–198 201 205 209 216 219 222 229 231 233 240 242–243 248–252 261–262 264–265 |

TABLE 1-continued

| TISSUE ORIGIN | RNA SOURCE | HYSEQ LIBRARY NAME | SEQ ID NOS: |
|---|---|---|---|
| | | | 272–273 278 284 288–289 292 296 298 300 303 307–308 310–311 322 325 327 329 334–335 339 343–346 349 351 354 365–366 378 382 388 392–393 396 399–400 402–403 406–407 412 418–423 427 434 436 447 449–450 457–462 468–469 471–473 475 481 485 487–488 494–497 499 509 511 513–514 517 523–524 526–530 534–535 537–540 542–546 549 551 559 563–565 567 572 575–576 582–583 587 589 591–592 595 597–598 603 605–607 609 611–612 614 617–619 621–622 624 634 637 640 642–643 648 650 653–654 656 658 664–666 668 671 673–674 677 679–680 682 684 686–688 692–695 697 700–701 706 708 710–712 714 717–718 721 726 729 733 735–738 740 743–744 748 752–753 756–760 762–763 767 774 776 778 784–786 793 795–796 798 801 805–806 808 815 823–824 828 830–831 833–834 837 841–842 845–847 856 859 861 867 884–885 887–889 891 893 897 903 905 908 911 916 924 931 937 942 947–948 955 957–960 966 968 970–971 973 975 978–979 985 990 995 998 1002 1007–1011 1019 1028–1029 1031 1034–1036 1039–1041 1043–1045 1047 1055–1056 1059 1068–1069 1073–1075 1084 1087 1090 1092 1094 1099 |
| lymphocytes | ATCC | LPC001 | 12 21 25 30 44 55 57 63 73 77–78 86 88 95 97 100–101 104–105 119 121–122 125 128–129 149 177 190 201–202 205 212–215 224 232–236 239 250 253 265 279 290 292–294 298 300 305–306 308 314–315 325 327 333 336–338 341–342 372 379 401 407 439 448 459–461 464 470 473–474 477 485 487 507 523 534 551 554 561 566–568 577 583 591–592 596 608–610 615 662 677 679 683 688 691–695 721 738 743 767 796 824 829–830 832 837 847 852 866 888 894 905 915 921 926 931 934 940 948 950 955 959–961 980–983 998 1002 1007 1009–1010 1029 1035–1036 1038 1040–1041 1047 1057 1059 1069 1071 1073–1074 1076–1077 1079 1084 1087 1096 |
| leukocyte | GIBCO | LUC001 | 1–3 6–7 13–15 21–22 25 27–31 43–44 53–58 60–61 73 77 79 82–84 86 88–90 95–99 104–105 108–109 111 113 115–116 119–125 127–128 130 133 135–138 142–146 148–153 155 157–159 161–165 170 173–175 177–178 183–187 190–193 197 201–202 204–206 209 211–215 217 222–224 228–230 232–235 242–243 247 250–253 255 258 260–262 265 269 272–274 278–279 281 283–284 288–290 292–298 300 304–306 311 314–315 320 322–328 333–334 338–339 341–346 349 351 356–357 360 364–366 374–378 380 382 388 390 392 399–404 409–410 413–420 422–423 427–430 433 435 437 440 443 449–450 452 454–462 464 468–470 472–474 477 480 483 485 487–488 495–496 499 502 504 511 513–515 517 519–521 523 528 530–545 548–549 551–556 562–564 |

TABLE 1-continued

| TISSUE ORIGIN | RNA SOURCE | HYSEQ LIBRARY NAME | SEQ ID NOS: |
|---|---|---|---|
| | | | 566–577 579–581 583 587 589–601 603 606–612 614 617–619 622–623 628–629 632 635–636 640 642–643 645 647–649 651 654 657–658 660 662 664 672–677 679–680 682–683 686–689 691–697 699 702 705–707 710–711 713 715 717–719 721–724 726 729 731 735 738 741–743 747–748 750–751 753 757 759 761 767 774–775 778–780 782 786 795–796 799–802 804–806 811–812 814 818 821–822 824–826 829–834 841 847 852 857 859–863 865–867 869 871–872 875 884 887–889 891 894–895 900 905 908–910 912–916 920–926 928–932 937 942 944 946 948 951–952 954–955 959–960 962–965 967 970–974 977–983 989–990 996 998 1002–1003 1007–1010 1012 1014–1020 1023–1025 1029 1031 1033–1037 1039 1043–1047 1049–1051 1055–1057 1059–1060 1063–1064 1067 1069–1071 1076–1077 1084 1090 1094 1100 |
| leukocyte | Clontech | LUC003 | 45 78 104–105 129 135 150–151 155 177 212–215 229 251–252 257 265 285–286 298–299 301 308 310 325 343–345 351 361 380 400 448 457 459–461 487 533 536 541–542 564 590–592 602 636 639 677 679 689 802 808 859 872 905 926–927 931 965 1036 1043 1047 1049 1067 |
| melanoma from cell line ATCC # CRL 1424 | Clontech | MEL004 | 9–11 18 24 45 53–54 56 60 86 89–90 104 119 122 128 130 141 155 164 173 177 201 203 221 223 243 251–252 264 278 290 292 325 339 341–342 346 418–419 421 443 462 471 474 485 517 530 541 544 554 563 568 572 590 601 619 621 645 663 672 677 679 686–687 713 719 726 738 744 757 763 777 788–791 796 825–827 838 845 852 861 879 884 889 903–904 906 915–916 925 928–929 934 943 968 970 983 1001 1010 1020 1024–1025 1035 1045 1057 1076–1077 1084 1094 1097 |
| mammary gland | Invitrogen | MMG001 | 1–2 4–5 7 12 14 17–16 21 23 29 32–33 35–36 41 44 49 52–56 61 63 66–68 70–71 79 82 86 88–89 97 104 108–111 115–118 122 125–129 136–138 148 150 153 156 159–160 162 164 168–169 172 177 180 183–186 190–191 193–194 197 202 204 209 212–216 222 224 229 231 233 238 248–250 263 265–267 274 279 284 295 300 305–306 310 312–318 322 325–326 328–330 334 336–337 339 341–342 346 349 351–354 356–358 361 364 370 377–378 388–389 392 396 400–401 404 406–414 416–418 420 422 427 431–432 434 439 443 445 450 454 464 468 470–473 478 488 491–492 494 499 502–507 512–514 522 527 539–543 548–549 551 554–555 557 563 566 574 578–585 589 591–592 596 603 606 608–610 613 622–624 633 635–636 640–641 644 647–648 650 652–653 657 664–665 671–676 680–684 687–688 692–694 696 701–702 704–705 711 713 715 720–721 724 727 731 733 744 746–747 752 757–764 766–767 774 776 778–780 784–791 796–797 |

TABLE 1-continued

| TISSUE ORIGIN | RNA SOURCE | HYSEQ LIBRARY NAME | SEQ ID NOS: |
|---|---|---|---|
| | | | 801–808 810–812 820–822 825–826 828–831 833–834 837–838 842 848 856 859 861–862 872–874 879–881 885–888 896–897 901 905–907 911–912 914 921 924 930–931 937 943–944 948–949 951–952 960–970 973 975–976 988 997 1004 1006–1010 1013–1015 1020 1024–1025 1032–1035 1039–1042 1044–1045 1049 1059–1060 1067 1069 1071 1073–1074 1079 1096 |
| induced neuron cells | Strategene | NTD001 | 3 13 31 44 48 50 53 55 96 98 166 171 207–208 217 221 224 242 262 272 289 323–325 332 418 459–462 464 476 484 506 511 541 543 560 623 640 672 677 679 729–731 744 761 793 882–883 895 912 936 943 964 978–979 981 984 1001 1010 1039 1049 1103 |
| retinoid acid induced neuronal cells | Strategene | NTR001 | 56 105 180 300 359 415 686–687 888 |
| neuronal cells | Strategene | NTU001 | 5 7 9–11 48 64 66 80 88–90 128 139–140 144 162 177 180 184–186 193 212–215 248–250 274 279 284 300 325 340 382 384 399 427 455 476 543 589 635 641 664 687 692–693 713 753 757 811 837 874 908 915 924 936 961 973 985–986 1001 1007–1010 1019–1020 1040 1045 1055–1056 1068 1073–1074 1090 1103 |
| pituitary gland | Clontech | PIT004 | 52 82 93 104 128 744 784–785 962–963 1002 1010 1068 |
| placenta | Clontech | PLA003 | 43 528 591–592 970 1007–1009 1059 |
| prostate | Clontech | PRT001 | 3 31 46 55–56 73 104 108–110 135–136 143 151 163 171 174 179–180 187 196 201 206–208 222 295 327 333 336–337 343–345 392 413 451 455 473 505 546 556 559 575–576 590 597 625 632 650–651 675–676 689 713 721 733 742 750 784–785 801 814 831 885 887 891 922–923 931 948 962–963 977 985 1003 1023 1031 1034 1039 1050 1052–1053 1057 |
| rectum | Invitrogen | REC001 | 14 17 41 46 61 68 82 88 94 104 115–116 120 122 138 142 157 191 212–215 222 243 261 265 279 300 305–306 310 323–325 329 336–337 351 401–403 405 409–410 422 432 434 440 446–447 450 454 458 474 504 510 528 534 536 566 588 594 598 635–636 647 673 683 708 711 721–722 753 756 759 764 775 797–798 802 819 828 842 848 861 867 874 876–878 894 909 914 930 934 961 1007–1010 1013 1024–1025 1040–1041 1045 1059 1063 1065 |
| salivary gland | Clontech | SAL001 | 6 24 27 33 84 111 122 147 161 168 170 175 210 230 245–246 248–249 266–267 301 314 329 443 446 448 452 455 472 485 494 511 533 550 564 591–592 612 620 650 704 708 713 728 734 744 755 792 839 861 870 924 971–972 978–979 988 1005 1010 1023 1026–1027 1036 1049 1063 1069 |
| skin fibroblast | ATCC | SFB001 | 1010 1090 |
| skin fibroblast | ATCC | SFB002 | 420 713 943 |
| skin fibroblast | ATCC | SFB003 | 391 808 1040 |

TABLE 1-continued

| TISSUE ORIGIN | RNA SOURCE | HYSEQ LIBRARY NAME | SEQ ID NOS: |
|---|---|---|---|
| small intestine | Clontech | SIN001 | 7 13 44 71 82 86 88 90 97 100–101 104 108–109 119 126 128 152 177 190 193 196 198 218 222 224 230 235 239 245–246 261 268 281 288 303 305–306 310 328 338 363 392–393 397 402 434 448 464 483 514 527 542 544 551 572 577 579–580 586 589 591–592 599 606 622 684–685 687 695–696 714–716 732 744 778 786 805–806 820 837 858 888 908 924 937 954 969 1006 1010 1016 1031 1033 1039 1041 1064 1077 1088 1090 1094 1098 |
| skeletal muscle | Clontech | SKM001 | 2 34 86 88 98 114 126 133 144 162 177–178 212–215 325 339 355–357 398 457 464 470 481 515 590 609 637 650 669 677 679 708 735 752 804–806 810 823 917–918 958 974 988 1011 1019 1026–1027 1033 1100 1104 |
| skeletal muscle | Clonetech | SKMS03 | 1100 |
| spinal cord | Clontech | SPC001 | 45 52 60 65 93 100–101 104 107 122 141 147 161 163 180 183 187 193 199 201 212–215 218 222 224 226 231 235 243 245–246 269 284 293–294 300 302 307 315 327–328 330 336–337 352–353 355 361 363–364 391 394 398 400 403 412–413 418 433–434 437 459–461 465 473 475 494 505 517 519–521 532–534 539–540 543 546 549 556–557 560 569 583 591–593 604 606 611 621 629 631 657 672 677 679–680 685 701 727 741 748 754 761 764 766 771 774 786 792 798 805–806 817 823 840 859 863 881–883 904 914 931 933 973 984 997 1002 1010 1013 1017 1020 1040 1043–1044 1046 1049 1058 1065 1090 1097–1098 |
| adult spleen | Clontech | SPLc01 | 21 98 100–101 105 530 551 1010 1020 1023 1034 1045–1047 1061 1077 1087 |
| stomach | Clontech | STO001 | 31 35 77 100–101 104 120 136 149 153 210 274 297 308 329 343–345 406 423 464 466 469 531 606 647 651 653–654 663 696 700 720 730 752 760 824 859 897 924–925 949 967 970–971 1012 1039 1049 1059 |
| Mixture of 16 tissues-mRNAs* | Various Vendors* | SUP002 | 4 37–38 47–48 94 108–109 472 544 859 1010 1016 1102 |
| Mixture of 16 tissues-mRNAs* | Various Vendors* | SUP005 | 88 99 108–109 115–116 195 547 1010 1064 1078 |
| Mixture of 16 tissues-mRNAs* | Various Vendors* | SUP008 | 19–20 24 82 98 104 115–116 157 326 705 852 952 1068 1073–1074 |
| Mixture of 16 tissues- mRNAs | Various Vendors* | SUP009 | 12 43 104 472 850–851 1010 1040 1043 1090 |
| thalamus | Clontech | THA002 | 6–7 14 24 29 37–38 52 61 66 69 93–94 115–116 132 151 157 182 200 206 224 243 283 285–286 325 333 348 363 398 409–411 420 458 466 468 478 512 568 575–576 584–585 648 684 686–688 691 694 722 744 786 818 833–834 839–840 846 861–862 866 882–883 897 909 939 970 995 1035 1045 1059 |
| thymus | Clonetech | THM001 | 3 6 15 24 31 44 84 104 119 139–140 142 145 157 161 167 177 180 183 191 201 210 212–215 221 223 229 231 243 260 262 266–267 281 |

TABLE 1-continued

| TISSUE ORIGIN | RNA SOURCE | HYSEQ LIBRARY NAME | SEQ ID NOS: |
|---|---|---|---|
| | | | 289 298 316–318 323–325 327 335 339 346 352 380 392 400 404 412 419 423 430 443 446 450–451 459–461 464 468–469 481 485 487 494 509 511 513 530 536 543–544 549 551 555–556 563 569 572 577 584–585 598 614 617–618 654 670 673 677 679 686 702 717–718 721 748 755 762 792 796 802 805–806 808 829–831 847 852 861 866 884 895 898 902 905 907–908 910–911 916 961 967 972 1010 1019 1039 1057 1059 1073–1074 |
| thymus | Clontech | THMc02 | 7 15 23 25–26 33 43–46 55 57 73 76 84 88–90 98 104–105 110 119 128–130 135 138–141 144 146 148–150 157 162 171 174 178 180 187 190 193–194 199 201 205–206 209 212–215 224 229–230 241–242 245–246 248–249 251–253 262–263 272 280–281 283 289 308–310 312 314 325 328 333 336–339 347 349 351 355–357 360 380 382 385 390 400 404 409–410 415 422–423 427–428 434–437 441 443 447–449 451 456–463 471 473–474 481 483 485 495 508 514 519–521 526 533 539–541 544 546 549 555–556 566 575–576 583 593–594 598 600 615 620 628 636 645 648 650 654 656 662 668 673 675–677 679 686 695–696 702 704 727 729 762–763 768 778 786 798 803–806 811 820 829–830 833–834 852 861 864–866 875 885 887 895 900 905 909 912 916 924–933 951–952 957 961 970–971 974 980 998 1007–1010 1012 1014–1015 1017 1020 1024– 1025 1029 1036 1040–1041 1045 1047 1050 1060 1064 1067–1069 1076 1079–1080 1082 1087 1090 1092–1093 1097–1098 |
| thyroid gland | Clontech | THR001 | 5 8 14–15 17 21 23 27 31–32 36 41 44–46 55–56 58 67 71 73–74 85 88–89 95 98 104–105 107–110 117–120 124–126 128–129 132 146–148 150–152 156 158–159 161–162 164–168 170–171 174–175 177–178 180 183–187 190–191 193 199 201–202 204 210–215 222 224 238 240 245–246 251–252 264 270 272 278–279 281 283 287 289 292–294 296–300 305–306 308 312–313 320 325 327–329 333 339 343–346 348 350 352 363 372–376 378 380 382 391 393 405 411–413 416 418 422 424–425 427 429 434 443 445 447 449 454 457 464 469 479–480 483 487 489 508–509 511 513 518 523 526–530 532 534 542–545 552 559–560 563 565–566 572–573 575–577 579–580 583 593 595–596 600–601 609–610 613–614 616 619–621 624 626 628–629 635 640 644 648 650–651 653 665–666 668–669 674 677 679 688 691–693 698 702 708 712 721 726–727 732 735 738 740–741 743 745 747 757 759–760 766–768 777 783–786 794–795 801–802 805–806 813 815 817–818 820 823 825–826 831–832 835–836 838–839 845 850–853 856 859–862 866–870 879 881 886 889 893 897–898 903 906 908 911 920 922–923 925 931 935 937 944 947–948 950 952 961–963 973 |

TABLE 1-continued

| TISSUE ORIGIN | RNA SOURCE | HYSEQ LIBRARY NAME | SEQ ID NOS: |
|---|---|---|---|
| | | | 976–979 989 996 1004 1010 1020–1022 1024–1025 1032 1035 1039 1055–1057 1060–1062 1064 1071 1084 1098 |
| trachea | Clontech | TRC001 | 4 25 45 50 57 88 98 119–120 128 146 148 165 170 236 255 264 269 274 284 289 303 363 384 403 495 544 551 563 579–580 599 603 609 619 622 734 764 769 788–791 802 897 904 918 922–923 927 971 1002 1075 1077 1096 |
| uterus | Clontech | UTR001 | 60 82 94 112 120 122 126 147 165 167 173 177 180 187 193 197 201 205 217–218 236 278 287 310 338 346 404 435 457 464 518 530 542 557 562 599 616 621 624 683 697 699 706 738 764 796 813 859 908 948 969 977 1000 1010 1013 1033–1034 1065 |

*The 16 tissue-mRNAs and their vendor source, are as follows: 1) Normal adult brain mRNA (Invitrogen), 2) normal adult kidney mRNA (Invitrogen), 3) normal adult liver mRNA (Invitrogen), 4) normal fetal brain mRNA (Invitrogen), 5) normal fetal kidney mRNA (Invitrogen), 6) normal fetal liver mRNA (Invitrogen), 7) normal fetal skin mRNA (Invitrogen), 8) human adrenal gland mRNA (Clontech), 9) human bone marrow mRNA (Clontech),10) human leukemia lymphablastic mRNA (Clontech), 11) human thymus mRNA (Clontech), 12) human lymph node mRNA (Clontech), 13) human spinal cord mRNA (Clontech), 14) human thyroid mRNA (Clontech), 15) human esophagus mRNA (BioChain), 16) human conceptional umbilical cord mRNA (BioChain).

TABLE 2

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 1 | 152 | AL122081 | Homo sapiens hypothetical protein | 1930 | 100 |
| 2 | 167 | AF212921 | Mus musculus MMTV receptor variant 1 | 484 | 94 |
| 3 | 205 | Z75330 | Homo sapiens nuclear protein SA-1 | 6492 | 99 |
| 4 | 210 | AL008583 | Homo sapiens dJ327J16.3 (supported by GENSCAN, FGENES and GENEWISE) | 2133 | 99 |
| 5 | 225 | AK000381 | Homo sapiens unnamed protein product | 1028 | 98 |
| 6 | 226 | AK000418 | Homo sapiens unnamed protein product | 1747 | 100 |
| 7 | 264 | AF156598 | Mus musculus p53-regulated DDA3 | 997 | 65 |
| 8 | 268 | AK001463 | Homo sapiens unnamed protein product | 1131 | 100 |
| 9 | 293 | AB033039 | Homo sapiens KIAA1213 protein | 2438 | 100 |
| 10 | 293 | AB033039 | Homo sapiens KIAA1213 protein | 1510 | 74 |
| 11 | 293 | AB033039 | Homo sapiens KIAA1213 protein | 2415 | 98 |
| 12 | 302 | AK001184 | Homo sapiens unnamed protein product | 2830 | 99 |
| 13 | 311 | AB021643 | Homo sapiens gonadotropin inducible transcription repressor-3 | 2761 | 99 |
| 14 | 352 | AL122089 | Homo sapiens hypothetical protein | 593 | 100 |
| 15 | 358 | AC007228 | Homo sapiens BC37295_1 | 1178 | 44 |
| 16 | 368 | L29154 | Homo sapiens immunoglobulin heavy chain VDJ region | 439 | 84 |
| 17 | 393 | AB037780 | Homo sapiens KIAA1359 protein | 1439 | 74 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 18 | 477 | AK000404 | *Homo sapiens* unnamed protein product | 1177 | 99 |
| 19 | 508 | L22557 | *Rattus norvegicus* calmodulin-binding protein | 1949 | 85 |
| 20 | 508 | L22557 | Rattus norvegicus calmodulin-binding protein | 2363 | 92 |
| 21 | 515 | AK002158 | *Homo sapiens* unnamed protein product | 1588 | 99 |
| 22 | 578 | AL080076 | *Homo sapiens* hypothetical protein | 107 | 30 |
| 23 | 588 | AJ251516 | *Mus musculus* cysteine and histidine-rich protein | 1460 | 99 |
| 24 | 591 | AL117551 | *Homo sapiens* hypothetical protein | 1773 | 100 |
| 25 | 593 | AB033076 | *Homo sapiens* KIAA1250 protein | 6286 | 100 |
| 26 | 594 | AK000625 | *Homo sapiens* unnamed protein product | 721 | 100 |
| 27 | 619 | AF161420 | *Homo sapiens* HSPC302 | 2623 | 97 |
| 28 | 620 | AL117477 | *Homo sapiens* hypothetical protein | 2551 | 100 |
| 29 | 654 | AK001782 | *Homo sapiens* unnamed protein product | 1161 | 100 |
| 30 | 692 | D25217 | *Homo sapiens* KIAA0027 protein | 1911 | 100 |
| 31 | 753 | AB041581 | *Mus musculus* unnamed protein product | 1758 | 95 |
| 32 | 758 | X03414 | *Drosophila melanogaster* Kr polypeptide | 316 | 45 |
| 33 | 787 | AF151079 | *Homo sapiens* HSPC245 | 643 | 100 |
| 34 | 833 | AK000643 | *Homo sapiens* unnamed protein product | 614 | 53 |
| 35 | 838 | AB029022 | *Homo sapiens* KIAA1099 protein | 1095 | 61 |
| 36 | 870 | AF213465 | *Homo sapiens* dual oxidase | 2016 | 100 |
| 37 | 891 | AF181562 | *Homo sapiens* proSAAS | 1319 | 100 |
| 38 | 891 | AF181562 | *Homo sapiens* proSAAS | 1024 | 99 |
| 39 | 921 | AB020671 | *Homo sapiens* KIAA0864 protein | 5438 | 99 |
| 40 | 924 | AB033051 | *Homo sapiens* KIAA1225 protein | 4438 | 100 |
| 41 | 932 | AB011105 | *Homo sapiens* KIAA0533 protein | 8255 | 100 |
| 42 | 942 | AB032983 | *Homo sapiens* KIAA1157 protein | 2231 | 100 |
| 43 | 958 | AF139077 | *Homo sapiens* M5-14 | 1463 | 98 |
| 44 | 968 | AK001366 | *Homo sapiens* unnamed protein product | 2940 | 97 |
| 45 | 992 | AF198454 | *Homo sapiens* epithelial protein lost in neoplasm beta | 3927 | 100 |
| 46 | 1025 | AK001753 | *Homo sapiens* unnamed protein product | 217 | 68 |
| 47 | 1074 | AF169017 | *Homo sapiens* formiminotransferase cyclodeaminase | 2717 | 98 |
| 48 | 1104 | A95106 | unidentified RED ALPHA | 1202 | 99 |
| 49 | 1114 | AL137479 | *Homo sapiens* hypothetical protein | 1942 | 100 |
| 50 | 1144 | AF072372 | *Mus musculus* lysosomal trafficking regulator 2 | 3388 | 97 |
| 51 | 1262 | M14912 | *Homo sapiens* pol | 132 | 86 |
| 52 | 1318 | AF090934 | *Homo sapiens* PRO0518 | 382 | 100 |
| 53 | 1319 | X66363 | *Homo sapiens* serine/threonine protein kinase | 2499 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 54 | 1328 | AF072758 | *Mus musculus* fatty acid transport protein 3; FATP3 | 2097 | 87 |
| 55 | 1436 | AB014514 | *Homo sapiens* KIAA0614 protein | 8406 | 100 |
| 56 | 1464 | AE003453 | *Drosophila melanogaster* CG10509 gene product | 654 | 51 |
| 57 | 1584 | AB033076 | *Homo sapiens* KIAA1250 protein | 6286 | 100 |
| 58 | 1617 | AB033067 | *Homo sapiens* KIAA1241 protein | 4229 | 99 |
| 59 | 1724 | D88585 | *Chlorocebus aethiops* hepatitis A virus receptor | 401 | 36 |
| 60 | 1728 | AF208845 | *Homo sapiens* BM-003 | 1375 | 99 |
| 61 | 1772 | AB015427 | *Homo sapiens* zinc finger protein 219 | 3934 | 100 |
| 62 | 1809 | X57821 | *Homo sapiens* immunoglobulin lambda light chain | 797 | 76 |
| 63 | 1868 | AF043695 | *Caenorhabditis elegans* Similar to mitochondrial carrier protein | 555 | 43 |
| 64 | 1898 | AB033039 | *Hotno sapiens* KIAA1213 protein | 2438 | 100 |
| 65 | 1926 | AK000279 | *Homo sapiens* unnamed protein product | 3271 | 99 |
| 66 | 1965 | AF178432 | *Homo sapiens* SH3 protein | 3700 | 100 |
| 67 | 1967 | AB033099 | *Homo sapiens* KIAA1273 protein | 3082 | 99 |
| 68 | 1995 | AF181721 | *Homo sapiens* RU2S | 2254 | 100 |
| 69 | 2005 | AL133093 | *Homo sapiens* hypothetical protein | 2241 | 100 |
| 70 | 2027 | U48238 | *Mus musculus* zinc finger protein neuro-d4 | 749 | 63 |
| 71 | 2055 | AL133105 | *Homo sapiens* hypothetical protein | 1783 | 99 |
| 72 | 2103 | AB032958 | *Homo sapiens* KIAA1132 protein | 9116 | 100 |
| 73 | 2106 | AE003528 | *Drosophila melanogaster* CG5018 gene product | 472 | 25 |
| 74 | 2166 | AK001713 | *Homo sapiens* unnamed protein product | 5323 | 99 |
| 75 | 2175 | AB010266 | *Mus musculus* tenascin-X | 10246 | 64 |
| 76 | 2176 | AE003746 | *Drosophila melanogaster* CG5986 gene product | 363 | 40 |
| 77 | 2194 | AL163206 | *Homo sapiens* protein with homology to KIAA0790 | 1944 | 100 |
| 78 | 2236 | AB033020 | *Homo sapiens* KIAA1194 protein | 2918 | 99 |
| 79 | 2250 | AL122081 | *Homo sapiens* hypothetical protein | 1930 | 100 |
| 80 | 2300 | AL133572 | *Homo sapiens* hypothetical protein | 3303 | 100 |
| 81 | 2323 | AB033107 | *Homo sapiens* KIAA1281 protein | 3228 | 100 |
| 82 | 2340 | AB030183 | *Mus musculus* contains transmembrane (TM) region | 380 | 42 |
| 83 | 2371 | Z18361 | *Ovis aries* trichohyalin | 184 | 32 |
| 84 | 2399 | AJ010045 | *Mus musculus* guanine nucleotide-exchange factor | 1470 | 58 |
| 85 | 2411 | AF176529 | *Mus musculus* F-box protein FBX13 | 2072 | 94 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 86 | 2428 | AF210842 | *Homo sapiens* HARP | 4880 | 100 |
| 87 | 2430 | AL031658 | *Homo sapiens* dJ310013.7 (novel protein similar to *H. roretzi* HRPET-3) | 776 | 98 |
| 88 | 2439 | X57398 | *Homo sapiens* pm5 protein | 6131 | 99 |
| 89 | 2447 | AE003779 | *Drosophiia melanogaster* CG2118 gene product | 1670 | 62 |
| 90 | 2461 | AL122097 | *Homo sapiens* hypothetical protein | 3213 | 99 |
| 91 | 2487 | AE003801 | *Drosophila melanogaster* CG14490 gene product | 247 | 38 |
| 92 | 2492 | AB033072 | *Homo sapiens* KIAA1246 protein | 4087 | 99 |
| 93 | 2512 | AB033103 | *Homo sapiens* KIAA1277 protein | 5252 | 99 |
| 94 | 2564 | AF117946 | *Homo sapiens* Link guanine nucleotide exchange factor II | 2363 | 100 |
| 95 | 2678 | AL133087 | *Homo sapiens* hypothetical protein | 4159 | 99 |
| 96 | 2816 | AK001529 | *Homo sapiens* unnamed protein product | 1420 | 99 |
| 97 | 2818 | AL137530 | *Homo sapiens* hypothetical protein | 433 | 94 |
| 98 | 2819 | AB028942 | *Homo sapiens* KIAA1019 protein | 7437 | 98 |
| 99 | 2943 | AF189722 | *Homo sapiens* PDZ-binding kinase | 1688 | 99 |
| 100 | 3137 | AE003450 | *Drosophila melanogaster* CG2221 gene product | 681 | 48 |
| 101 | 3137 | AE003450 | *Drosophila melanogaster* CG2221 gene product | 716 | 38 |
| 102 | 3160 | AK000708 | *Homo sapiens* unnamed protein product | 1103 | 99 |
| 103 | 3323 | Y07829 | *Homo sapiens* RING finger protein | 2201 | 99 |
| 104 | 3360 | AB007931 | *Homo sapiens* KIAA0462 protein | 11741 | 99 |
| 105 | 3362 | U41387 | *Homo sapiens* Gu protein | 4021 | 99 |
| 106 | 3417 | AF023674 | *Homo sapiens* nephrocystin | 3783 | 100 |
| 107 | 3418 | AF146760 | *Homo sapiens* septin 2-like cell division control protein | 2284 | 100 |
| 108 | 3442 | Z66524 | *Caenorhabditis elegans* Homology with Squid retinal-binding protein (PIR Acc. No. A53057) ~cDNA EST yk463d10.3 comes from this gene~cDNA EST yk663h12.3 comes from this gene | 1190 | 48 |
| 109 | 3442 | Z66524 | *Caenorhabditis elegans* Homology with Squid retinal-binding protein (PIR Acc. No. A53057) ~cDNA EST yk463d10.3 comes from this gene~cDNA EST yk663h12.3 comes from this gene | 848 | 42 |
| 110 | 3444 | M26576 | *Homo sapiens* alpha-1 type IV collagen | 9412 | 99 |
| 111 | 3855 | AF113536 | *Homo sapiens* MO25 protein | 1381 | 81 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 112 | 3863 | AJ271385 | *Homo sapiens* UDP-N-acetyl-alpha-D-galactosamine:polypeptide N-acetylgalactosaminyl transferase 8 | 733 | 46 |
| 113 | 4090 | AF105228 | *Bos taurus* tuftelin | 285 | 33 |
| 114 | 4105 | U32614 | *Mus musculus* SOX6 | 2855 | 96 |
| 115 | 4142 | X14971 | *Mus musculus* alpha-adaptin (A) (AA 1–977) | 4897 | 98 |
| 116 | 4142 | X53773 | *Rattus norvegicus* alpha-c large chain (AA 1–938) | 3979 | 82 |
| 117 | 4149 | AF034746 | *Mus musculus* LNXp70 | 2922 | 88 |
| 118 | 4196 | AC006551 | *Arabidopsis thaliana* Hypothetical protein | 214 | 34 |
| 119 | 4202 | AF229032 | *Mus musculus* piL | 2077 | 93 |
| 120 | 4274 | AF056035 | *Rattus norvegicus* s-nexilin | 2662 | 85 |
| 121 | 4304 | AK000080 | *Homo sapiens* unnamed protein product | 3037 | 99 |
| 122 | 4306 | D88158 | *Sus scrofa* cytochrome b561 | 474 | 47 |
| 123 | 4311 | AF161445 | *Homo sapiens* HSPC327 | 1606 | 100 |
| 124 | 4321 | AL133112 | *Homo sapiens* hypothetical protein | 1861 | 100 |
| 125 | 4323 | AL137432 | *Homo sapiens* hypothetical protein | 3002 | 100 |
| 126 | 4332 | AF186461 | *Rattus norvegicus* ring finger protein Fxy | 204 | 22 |
| 127 | 4488 | AE003749 | *Drosophila melanogaster* CG13644 gene product | 422 | 33 |
| 128 | 4588 | D87438 | *Homo sapiens* Similar to a *C. elegans* protein in cosmid C14H10 | 4069 | 100 |
| 129 | 5569 | D87442 | *Homo sapiens* KIAA0253 | 3682 | 100 |
| 130 | 5573 | Z15005 | *Homo sapiens* CENP-E | 13305 | 99 |
| 131 | 5577 | M59216 | *Homo sapiens* gamma-aminobutyric acid receptor beta-1 subunit | 2477 | 100 |
| 132 | 5579 | D31884 | *Homo sapiens* KIAA0063 | 518 | 55 |
| 133 | 5582 | AF188706 | *Homo sapiens* g20 protein | 188 | 49 |
| 134 | 5583 | AB029030 | *Homo sapiens* KIAA1107 protein | 6581 | 99 |
| 135 | 5584 | D87446 | *Homo sapiens* Similar to a *C. elegans* protein encoded in cosmid C27F2 (U40419) | 9196 | 99 |
| 136 | 5585 | AF047663 | *Caenorhabditis elegans* W09G12.7 gene product | 22S | 37 |
| 137 | 5591 | AC002398 | *Homo sapiens* F25965_1 | 1018 | 100 |
| 138 | 5593 | AB023215 | *Homo sapiens* KIAA0998 protein | 6323 | 99 |
| 139 | 5594 | AF223408 | *Homo sapiens* B99 | 3686 | 99 |
| 140 | 5594 | AF223408 | *Homo sapiens* B99 | 2878 | 88 |
| 141 | 5598 | D83781 | *Homo sapiens* the KIAA0197 gene is expressed ubiquitously.; the KIAA0197 protein has histidine acid phosphatase signature at amino acid positions 1047–1061. | 6859 | 99 |
| 142 | 5602 | U53450 | *Rattus norvegicus* Jun dimerization protein 1 JDP-1 | 196 | 49 |
| 143 | 5605 | AL117233 | *Homo sapiens* hypothetical protein | 3564 | 99 |
| 144 | 5608 | U38253 | *Rattus norvegicus* initiation factor eIF-2B gamma subunit | 1203 | 89 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 145 | 5617 | AE003538 | *Drosophila melanogaster* CG10191 gene product | 354 | 44 |
| 146 | 5620 | AB020694 | *Homo sapiens* KIAA0887 protein | 2328 | 100 |
| 147 | 5622 | AB029025 | *Homo sapiens* KIAA1102 protein | 4394 | 100 |
| 148 | 5623 | AL137255 | *Homo sapiens* hypothetical protein | 2636 | 100 |
| 149 | 5624 | AB018289 | *Homo sapiens* KIAA0746 protein | 5223 | 99 |
| 150 | 5625 | D38549 | *Homo sapiens* ha1025 is new | 6533 | 99 |
| 151 | 5627 | AF241230 | *Homo sapiens* TAK1-binding protein 2 | 3656 | 100 |
| 152 | 5628 | AK000759 | *Homo sapiens* unnamed protein product | 3306 | 100 |
| 153 | 5630 | AL117665 | *Homo sapiens* hypothetical protein | 6463 | 100 |
| 154 | 5632 | AF161544 | *Homo sapiens* HSPC059 | 434 | 77 |
| 155 | 5640 | AJ238248 | *Homo sapiens* centaurin beta2 | 3986 | 99 |
| 156 | 5641 | AB007929 | *Homo sapiens* KIAA0460 protein | 4781 | 99 |
| 157 | 5643 | AF161381 | *Homo sapiens* HSPC263 | 1404 | 100 |
| 158 | 5647 | AF223468 | *Homo sapiens* AD021 protein | 1314 | 100 |
| 159 | 5649 | AF203343 | *Mus musculus* RIBP | 115 | 39 |
| 160 | 5658 | X57527 | *Homo sapiens* alpha 1 (VIII) collagen | 4166 | 99 |
| 161 | 5659 | Y19062 | *Homo sapiens* 39k3 protein | 2475 | 100 |
| 162 | 5667 | AK000566 | *Homo sapiens* unnamed protein product | 1053 | 100 |
| 163 | 5672 | AL021918 | *Homo sapiens* b34I8.1 (Kruppel related Zinc Finger protein 184) | 4184 | 100 |
| 164 | 5674 | AB020706 | *Homo sapiens* KIAA0899 protein | 4732 | 100 |
| 165 | 5678 | AB040915 | *Homo sapiens* KIAA1482 protein | 2828 | 99 |
| 166 | 5680 | AE001448 | *Helicobacter pylori* J99 THREONINE SYNTHASE | 698 | 37 |
| 167 | 5684 | AF226614 | *Homo sapiens* ferroportin1 | 2929 | 100 |
| 168 | 5686 | Z93241 | *Homo sapiens* dJ222E13.1 (novel protein with some similarity to Drosophila KRAKEN) | 513 | 96 |
| 169 | 5694 | AF036977 | *Homo sapiens* unknown | 1812 | 100 |
| 170 | 5698 | AK001746 | *Homo sapiens* unnamed protein product | 141 | 45 |
| 171 | 5699 | AF108843 | *Homo sapiens* env protein | 320 | 47 |
| 172 | 5712 | AF069781 | *Drosophila melanogaster* Bem46-like protein | 653 | 43 |
| 173 | 5719 | U95098 | *Xenopus laevis* mitotic phosphoprotein 44 | 1200 | 70 |
| 174 | 5720 | X70944 | *Homo sapiens* PTB-associated splicing factor | 3883 | 100 |
| 175 | 5727 | AE003741 | *Drosophila melanogaster* CG13832 gene product | 456 | 44 |
| 176 | 5730 | AF195833 | *Mus musculus* cell adhesion molecule nectin-3 alpha | 2693 | 93 |
| 177 | 5734 | AJ249732 | *Homo sapiens* G8 protein | 669 | 100 |
| 178 | 5738 | AF208861 | *Homo sapiens* BM-019 | 1629 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 179 | 5739 | L09708 | *Homo sapiens* complement component C2 | 4022 | 100 |
| 180 | 5740 | AF156961 | *Homo sapiens* gag | 106 | 47 |
| 181 | 5744 | X66285 | *Mus musculus* HC1 ORF | 115 | 44 |
| 182 | 5748 | D00189 | *Rattus norvegicus* Na+, K+-ATPase alpha-subunit | 5227 | 99 |
| 183 | 5749 | U10185 | *Xenopus laevis* XPMC2 protein | 1020 | 53 |
| 184 | 5750 | AB019038 | *Homo sapiens* beta-1,4 mannosyltransferase | 781 | 77 |
| 185 | 5750 | AB019038 | *Homo sapiens* beta-1,4 mannosyltransferase | 1347 | 100 |
| 186 | 5750 | AB019038 | *Homo sapiens* beta-1,4 mannosyltransferase | 1520 | 99 |
| 187 | 5761 | X84908 | *Homo sapiens* phosphorylase kinase | 5729 | 99 |
| 188 | 5762 | X52851 | *Homo sapiens* peptidylprolyl isomerase | 650 | 76 |
| 189 | 5767 | AJ245671 | *Homo sapiens* hypothetical protein | 3064 | 100 |
| 190 | 5773 | AC004447 | *Homo sapiens* KIAA0365 | 4963 | 99 |
| 191 | 5783 | U04706 | *Bos taurus* 50 kDa protein | 1749 | 78 |
| 192 | 5784 | AF092207 | *Rattus norvegicus* unknown | 1180 | 84 |
| 193 | 5788 | AK001934 | *Homo sapiens* unnamed protein product | 1368 | 100 |
| 194 | 5798 | AK000284 | *Homo sapiens* unnamed protein product | 3385 | 97 |
| 195 | 5802 | AF247042 | *Homo sapiens* tandem pore domain potassium channel TRAAK | 2186 | 99 |
| 196 | 5807 | AF114494 | *Homo sapiens* putative tyrosine phosphatase | 1284 | 99 |
| 197 | 5818 | AE000995 | *Archaeoglobus fulgidus* chromosome segregation protein (smc1) | 153 | 20 |
| 198 | 5819 | AF062249 | *Homo sapiens* immunoglobulin heavy chain variable region | 605 | 97 |
| 199 | 5827 | AJ223830 | *Rattus norvegicus* ARE1 | 2950 | 98 |
| 200 | 5828 | AL133027 | *Homo sapiens* hypothetical protein | 1224 | 84 |
| 201 | 5842 | D87684 | *Homo sapiens* KIAA0242 protein | 2566 | 100 |
| 202 | 5853 | AL050318 | *Homo sapiens* dJ977B1.3.1 (novel protein similar to putative RAB5-interacting protein (isoform 1)) | 524 | 79 |
| 203 | 5861 | D49387 | *Homo sapiens* NADP dependent leukotriene b4 12-hydroxydehydrogenase | 1616 | 100 |
| 204 | 5864 | AL050022 | *Homo sapiens* hypothetical protein | 330 | 34 |
| 205 | 5865 | AL050267 | *Homo sapiens* hypothetical protein | 3325 | 99 |
| 206 | 5871 | AL137300 | *Homo sapiens* hypothetical protein | 1056 | 98 |
| 207 | 5873 | AK001480 | *Homo sapiens* unnamed protein product | 1562 | 99 |
| 208 | 5873 | AK001480 | *Homo sapiens* unnamed protein product | 1082 | 98 |
| 209 | 5875 | X12966 | *Homo sapiens* 3-oxoacyl-CoA thiolase propeptide (424 AA) | 1972 | 100 |
| 210 | 5878 | Y09267 | *Homo sapiens* flavin-containing monooxygenase 2 | 2486 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 211 | 5879 | Z11773 | Homo sapiens SRE-ZBP | 2201 | 99 |
| 212 | 5880 | D84224 | Homo sapiens methionyl tRNA synthetase | 4741 | 99 |
| 213 | 5880 | D84224 | Homo sapiens methionyl tRNA synthetase | 3887 | 99 |
| 214 | 5880 | D84224 | Homo sapiens methionyl tRNA synthetase | 2933 | 96 |
| 215 | 5880 | D84224 | Homo sapiens methionyl tRNA synthetase | 4529 | 99 |
| 216 | 5885 | J03244 | Bos taurus H+ ATPase 31 kDa subunit (EC 3.6.1.3) | 848 | 77 |
| 217 | 5895 | AK001589 | Homo sapiens unnamed protein product | 2313 | 100 |
| 218 | 5898 | AL117615 | Homo sapiens hypothetical protein | 3174 | 99 |
| 219 | 5902 | AE003735 | Drosophila melanogaster CG6353 gene product | 436 | 58 |
| 220 | 5904 | A06669 | synthetic construct preTGF-beta1 | 2070 | 99 |
| 221 | 5918 | AE003487 | Drosophila melanogaster CG1905 gene product | 238 | 26 |
| 222 | 5921 | AL110243 | Homo sapiens hypothetical protein | 2275 | 100 |
| 223 | 5927 | X60271 | Mus musculus c-rel | 2264 | 74 |
| 224 | 5932 | AK001475 | Homo sapiens unnamed protein product | 3025 | 100 |
| 225 | 5939 | AF131851 | Homo sapiens Unknown | 262 | 44 |
| 226 | 5945 | AB002320 | Homo sapiens KIAA0322 | 8183 | 100 |
| 227 | 5946 | AE003518 | Drosophila melanogaster CG6836 gene product | 135 | 22 |
| 228 | 5947 | AF119855 | Homo sapiens PRO1847 | 265 | 67 |
| 229 | 5956 | M17236 | Homo sapiens MHC HLA-DQ alpha precursor | 1332 | 100 |
| 230 | 5967 | AK001345 | Homo sapiens unnamed protein product | 1453 | 99 |
| 231 | 5968 | M28515 | Mus musculus zinc finger protein mfg3 mRNA (put.); putative | 225 | 28 |
| 232 | 5975 | AB037730 | Homo sapiens KIAA1309 protein | 515 | 44 |
| 233 | 5977 | AE003464 | Drosophila melanogaster CG11414 gene product | 610 | 44 |
| 234 | 5978 | M12140 | Homo sapiens pol gene protein; Xxx | 117 | 50 |
| 235 | 5979 | U79267 | Homo sapiens unknown | 225 | 56 |
| 236 | 5980 | X56681 | Homo sapiens junD protein | 373 | 88 |
| 237 | 5988 | AB023151 | Homo sapiens KIAA0934 protein | 7099 | 100 |
| 238 | 5989 | AL109839 | Homo sapiens dJ1069P2.3.1 (novel PABPC1 (poly(A) - binding protein, cytoplasmic 1) (PABPL1) like protein (putative isoform 1)) | 877 | 100 |
| 239 | 5991 | AE003583 | Drosophila melanogaster BcDNA:GH09817 gene product | 289 | 42 |
| 240 | 5997 | AF052723 | Feline leukemia virus gag-pol precursor polyprotein gPr80 | 1547 | 44 |
| 241 | 5998 | AF161472 | Homo sapiens HSPC123 | 439 | 45 |
| 242 | 6003 | AK000360 | Homo sapiens unnamed protein product | 796 | 100 |
| 243 | 6004 | U09848 | Homo sapiens zinc finger protein | 1738 | 100 |
| 244 | 6013 | U19177 | Homo sapiens Hin-2 | 55 | 46 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 245 | 6028 | AF155113 | *Homo sapiens* NY-REN-55 antigen | 3603 | 93 |
| 246 | 6028 | AF155113 | *Homo sapiens* NY-REN-55 antigen | 3951 | 99 |
| 247 | 6029 | AL032821 | *Homo sapiens* dJ55C23.1 (vanin 1) | 1821 | 98 |
| 248 | 6031 | M69181 | *Homo sapiens* non-muscle myosin B | 7350 | 99 |
| 249 | 6031 | M69181 | *Homo sapiens* non-muscle myosin B | 7311 | 98 |
| 250 | 6032 | X61280 | *Oryza sativa* hydroxyproline-rich glycoprotein | 143 | 38 |
| 251 | 6037 | AB002330 | *Homo sapiens* KIAA0332 | 5362 | 100 |
| 252 | 6037 | AB002330 | *Homo sapiens* KIAA0332 | 4897 | 97 |
| 253 | 6043 | X06745 | *Homo sapiens* DNA polymerase alpha-subunit (AA 1-1462) | 7619 | 99 |
| 254 | 6044 | AF252292 | *Homo sapiens* PAR6C | 1342 | 100 |
| 255 | 6046 | D86984 | *Homo sapiens* similar to yeast adenylate cyclase (S56776) | 2446 | 100 |
| 256 | 6048 | AF165124 | *Homo sapiens* gamma-aminobutyric acid A receptor gamma 2 | 2499 | 99 |
| 257 | 6049 | AF110267 | *Rattus norvegicus* golgi stacking protein homolog GRASP55 | 2088 | 89 |
| 258 | 6051 | U82319 | *Homo sapiens* novel ORF | 342 | 100 |
| 259 | 6053 | Y00816 | *Homo sapiens* CR1 precursor protein | 11396 | 99 |
| 260 | 6060 | AJ223948 | *Homo sapiens* RNA helicase | 6608 | 99 |
| 261 | 6063 | Y08612 | *Homo sapiens* 88 kDa nuclear pore complex protein | 3874 | 99 |
| 262 | 6066 | AB014597 | *Homo sapiens* KIAA0697 protein | 5060 | 100 |
| 263 | 6067 | AF129756 | *Homo sapiens* BAT4 | 1873 | 98 |
| 264 | 6068 | AF131775 | *Homo sapiens* Unknown | 1929 | 99 |
| 265 | 6073 | AJ250865 | *Homo sapiens* TESS 2 | 2348 | 100 |
| 266 | 6076 | Z98885 | *Homo sapiens* dJ522J7.2 (bromodomain-containing 1 (similar to peregrin, BR140)) | 5588 | 100 |
| 267 | 6076 | Z98885 | *Homo sapiens* dJ522J7.2 (bromodomain-containing 1 (similar to peregrin, BR140)) | 4167 | 100 |
| 268 | 6077 | L76571 | *Homo sapiens* nuclear hormone receptor | 1355 | 100 |
| 269 | 6079 | AF091622 | *Homo sapiens* PHD finger protein 3 | 9054 | 100 |
| 270 | 6082 | X56807 | *Homo sapiens* desmocollin type 2a | 4443 | 100 |
| 271 | 6087 | AC002464 | *Homo sapiens* organic cation transporter; 50% similarity to JC4884 (PID:g2143892) | 1542 | 99 |
| 272 | 6088 | AL050272 | *Homo sapiens* hypothetical protein | 697 | 99 |
| 273 | 6091 | AL022329 | *Homo sapiens* bK407F11.2 (adrenergic, beta, receptor kinase 2) | 3653 | 100 |
| 274 | 6094 | AK000833 | *Homo sapiens* unnamed protein product | 2001 | 98 |
| 275 | 6101 | AJ245600 | *Homo sapiens* hypothetical protein | 2616 | 99 |
| 276 | 6103 | AB041810 | *Mus musculus* unnamed protein product | 1468 | 91 |
| 277 | 6104 | L36531 | *Homo sapiens* integrin alpha 8 subunit | 5386 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 278 | 6108 | AL117646 | Homo sapiens hypothetical protein | 1491 | 100 |
| 279 | 6112 | AF218584 | Homo sapiens GGA1 | 3265 | 100 |
| 280 | 6121 | Y13115 | Homo sapiens serine/threonine protein kinase | 5071 | 99 |
| 281 | 6125 | AB018319 | Homo sapiens KIAA0776 protein | 3960 | 99 |
| 282 | 6126 | AL034452 | Homo sapiens dJ682J15.1 (novel Collagen triple helix repeat containing protein) | 1979 | 100 |
| 283 | 6128 | Y14494 | Homo sapiens aralar1 | 3465 | 99 |
| 284 | 6129 | AJ001981 | Homo sapiens OXA1L | 2603 | 100 |
| 285 | 6133 | A58799 | unidentified unnamed protein product | 3069 | 100 |
| 286 | 6133 | A58799 | unidentified unnamed protein product | 2464 | 100 |
| 287 | 6135 | AF163572 | Homo sapiens Forssman glycolipid synthetase | 1865 | 99 |
| 288 | 6139 | AF161503 | Homo sapiens HSPC154 | 1261 | 97 |
| 289 | 6141 | AB011125 | Homo sapiens KIAA0553 protein | 5754 | 100 |
| 290 | 6145 | AJ250014 | Homo sapiens Familial Cylindromatosis Gene | 3655 | 99 |
| 291 | 6146 | D25217 | Homo sapiens KIAA0027 protein | 361 | 94 |
| 292 | 6148 | X85786 | Homo sapiens binding regulatory factor | 3203 | 100 |
| 293 | 6149 | Y08319 | Homo sapiens kinesin-2 | 3487 | 99 |
| 294 | 6149 | D12644 | Mus musculus KIF2 protein | 3609 | 97 |
| 295 | 6153 | U28789 | Mus musculus PACT | 5936 | 89 |
| 296 | 6159 | AL137515 | Homo sapiens hypothetical protein | 1687 | 100 |
| 297 | 6164 | AB020705 | Homo sapiens KIAA0898 protein | 5017 | 100 |
| 298 | 6167 | Y00062 | Homo sapiens precursor polypeptide (AA-23 to 1120) | 3440 | 99 |
| 299 | 6172 | AB007941 | Homo sapiens KIAA0472 protein | 1925 | 99 |
| 300 | 6173 | X98248 | Homo sapiens sortilin | 4403 | 99 |
| 301 | 6190 | X61100 | Homo sapiens 75 kDa subunit NADH dehydrogenase precursor | 3734 | 99 |
| 302 | 6194 | S58544 | Homo sapiens 75 kDa infertility-related sperm protein | 2125 | 99 |
| 303 | 6196 | AL110265 | Homo sapiens hypothetical protein | 744 | 100 |
| 304 | 6197 | X14968 | Homo sapiens RII-alpha subunit (AA 1–404) | 2079 | 100 |
| 305 | 6198 | AL050283 | Homo sapiens hypothetical protein | 1983 | 100 |
| 306 | 6198 | AL050283 | Homo sapiens hypothetical protein | 1694 | 100 |
| 307 | 6205 | AJ011863 | Homo sapiens homeobox protein LSX | 3841 | 99 |
| 308 | 6214 | AF098786 | Homo sapiens 17 beta-hydroxysteroid dehydrogenase type VII | 1754 | 100 |
| 309 | 6215 | AL034555 | Homo sapiens dJ134O19.3 (zinc finger protein 151 (pHZ-67)) | 4273 | 100 |
| 310 | 6219 | AB011167 | Homo sapiens KIAA0595 protein | 7678 | 98 |
| 311 | 6226 | U39205 | Saccharomyces cerevisiae Lpe10p | 277 | 29 |
| 312 | 6229 | AF041429 | Homo sapiens pRGR1 | 823 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 313 | 6234 | X66357 | Homo sapiens serine/threonine protein kinase | 1589 | 100 |
| 314 | 6237 | Y11284 | Homo sapiens AFX1 | 2571 | 98 |
| 315 | 6238 | AB004884 | Homo sapiens PKU-alpha | 3718 | 99 |
| 316 | 6239 | AJ002303 | Homo sapiens synaptogyrin 1c | 1020 | 100 |
| 317 | 6239 | AJ002304 | Homo sapiens synaptogyrin 1b | 1002 | 100 |
| 318 | 6239 | AJ002303 | Homo sapiens synaptogyrin 1c | 933 | 94 |
| 319 | 6240 | D87682 | Homo sapiens similar to a C. elegans protein encoded in cosmid T26A5. | 2676 | 100 |
| 320 | 6244 | M14660 | Homo sapiens ISG-K54 | 2473 | 99 |
| 321 | 6245 | X06661 | Homo sapiens calbindin (AA 1–261) | 1358 | 100 |
| 322 | 6250 | AF119900 | Homo sapiens PR02822 | 185 | 76 |
| 323 | 6252 | AB014527 | Homo sapiens KIAA0627 protein | 6478 | 99 |
| 324 | 6252 | AB014527 | Homo sapiens KIAA0627 protein | 6372 | 98 |
| 325 | 6256 | X86691 | Homo sapiens Mi-2 protein | 10110 | 99 |
| 326 | 6260 | AE003628 | Drosophila melanogaster CG7475 gene product | 985 | 57 |
| 327 | 6261 | AF236061 | Oryctolagus cuniculus RING-finger binding protein | 3830 | 91 |
| 328 | 6264 | AB018327 | Homo sapiens KIAA0784 protein | 5708 | 100 |
| 329 | 6265 | AB018314 | Homo sapiens KIAA0771 protein | 4949 | 100 |
| 330 | 6266 | AB002318 | Homo sapiens KIAA0320 | 4639 | 99 |
| 331 | 6270 | X14766 | Homo sapiens GABA-A receptor alpha 1 subunit | 2388 | 99 |
| 332 | 6271 | AB023177 | Homo sapiens KIAA0960 protein | 7294 | 99 |
| 333 | 6272 | AB032957 | Homo sapiens KIAA1131 protein | 8443 | 100 |
| 334 | 6274 | AF007155 | Homo sapiens unknown | 187 | 61 |
| 335 | 6276 | Z34975 | Homo sapiens 1d1Cp | 3733 | 100 |
| 336 | 6281 | AL050306 | Homo sapiens dJ475B7.2 (novel protein) | 3796 | 100 |
| 337 | 6281 | AL050306 | Homo sapiens dJ475B7.2 (novel protein) | 1942 | 99 |
| 338 | 6288 | AB014566 | Homo sapiens KIAA0666 protein | 5541 | 100 |
| 339 | 6292 | AB018353 | Homo sapiens KIAA0810 protein | 4246 | 100 |
| 340 | 6294 | Z21966 | Homo sapiens mPOU homeobox protein | 1529 | 100 |
| 341 | 6299 | AL022395 | Homo sapiens dJ273N12.1 (PUTATIVE protein based on EST matches) | 3287 | 100 |
| 342 | 6299 | AL022395 | Homo sapiens dJ273N12.1 (PUTATIVE protein based on EST matches) | 2403 | 83 |
| 343 | 6312 | AL096713 | Homo sapiens hypothetical protein | 7599 | 99 |
| 344 | 6312 | AF182316 | Homo sapiens myoferlin | 6232 | 99 |
| 345 | 6312 | AL096713 | Homo sapiens hypothetical protein | 6120 | 99 |
| 346 | 6322 | AK000218 | Homo sapiens unnamed protein product | 1163 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 347 | 6324 | D42046 | *Homo sapiens* The ha3631 gene product is related to *S. cerevisiae* protein encoded in chromosome VIII. | 5568 | 100 |
| 348 | 6328 | AB023624 | *Rattus norvegicus* SCOP | 4792 | 92 |
| 349 | 6329 | X59303 | *Homo sapiens* valyl-tRNA synthetase | 3393 | 99 |
| 350 | 6331 | AC004142 | *Homo sapiens* similar to murine leucine-rich repeat protein; possible role in neural development by protein-protein interactions; 93% similarity to D49802 (PID:g1369906) | 3676 | 100 |
| 351 | 6333 | AC009991 | *Arabidopsis thaliana* unknown protein | 609 | 51 |
| 352 | 6334 | AB018271 | *Homo sapiens* KIAA0728 protein | 4316 | 98 |
| 353 | 6337 | AB002318 | *Homo sapiens* KIAA0320 | 4639 | 99 |
| 354 | 6339 | AB039371 | *Homo sapiens* mitochondrial ABC transporter 3 | 2902 | 99 |
| 355 | 6346 | AK002198 | *Homo sapiens* unnamed protein product | 2570 | 99 |
| 356 | 6348 | AB033087 | *Homo sapiens* KIAA1261 protein | 4094 | 99 |
| 357 | 6348 | L14463 | *Rattus norvegicus* transducin | 3619 | 92 |
| 358 | 6350 | AC005757 | *Homo sapiens* R32611_1 | 2779 | 100 |
| 359 | 6351 | S61069 | *Homo sapiens* reverse transcriptase homolog = pol {retroviral element} | 252 | 66 |
| 360 | 6355 | AF271388 | *Homo sapiens* CMP-N-acetylneuraminic acid synthase | 2273 | 100 |
| 361 | 6362 | X79066 | *Homo sapiens* ERF-1 | 1783 | 100 |
| 362 | 6368 | AF118566 | *Mus musculus* hematopoietic zinc finger protein | 769 | 51 |
| 363 | 6369 | AB020710 | *Homo sapiens* KIAA0903 protein | 4915 | 99 |
| 364 | 6371 | AF143321 | *Homo sapiens* unknown | 661 | 65 |
| 365 | 6376 | AF260011 | *Homo sapiens* HSPC087-KIAA0714 | 8764 | 99 |
| 366 | 6379 | 583365 | *Homo sapiens* putative Rab5-interacting protein {clone L1-94} | 131 | 49 |
| 367 | 6380 | AL021878 | *Homo sapiens* dJ257I204 (transcription factor 20 (AR1) (KIAA0292) (isoform 2)) | 154 | 68 |
| 368 | 6381 | D90734 | *Escherichia coli* ORF_ID:o223#11 | 628 | 100 |
| 369 | 6392 | M58378 | *Homo sapiens* synapsin I | 3730 | 99 |
| 370 | 6395 | AF039697 | *Homo sapiens* antigen NY-CO-31 | 508 | 98 |
| 371 | 6397 | U09355 | *Oryctolagus cuniculus* protein phosphatase 2A1 B gamma subunit | 2356 | 99 |
| 372 | 6400 | AB002293 | *Homo sapiens* KIAA0295 | 5054 | 100 |
| 373 | 6401 | AC004774 | *Homo sapiens* Dlx-5 | 1542 | 100 |
| 374 | 6411 | X90530 | *Homo sapiens* ragB | 1926 | 99 |
| 375 | 6411 | X90530 | *Homo sapiens* ragB | 1405 | 99 |
| 376 | 6411 | X90530 | *Homo sapiens* ragB | 1590 | 85 |
| 377 | 6416 | AL080157 | *Homo sapiens* hypothetical protein | 2100 | 94 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 378 | 6418 | AE003628 | *Drosophila melanogaster* CG5188 gene product | 659 | 49 |
| 379 | 6422 | AB007884 | *Homo sapiens* KIAA0424 | 2757 | 99 |
| 380 | 6423 | AB018323 | *Homo sapiens* KIAA0780 protein | 5631 | 100 |
| 381 | 6426 | AF042713 | *Rattus norvegicus* neurexophilin 3 | 1337 | 96 |
| 382 | 6427 | AJ131891 | *Homo sapiens* DNA polymerase mu | 1451 | 100 |
| 383 | 6428 | AF221712 | *Homo sapiens* Smad- and Olf-interacting zinc finger protein | 6705 | 100 |
| 384 | 6429 | X83573 | *Homo sapiens* ARSE | 3184 | 99 |
| 385 | 6430 | AJ243274 | *Homo sapiens* AP-2rep protein | 2078 | 99 |
| 386 | 6432 | AL035608 | *Homo sapiens* dJ479J7.1 (similar to CHONDROMODULIN-1) | 1440 | 100 |
| 387 | 6432 | AL035608 | *Homo sapiens* dJ479J7.1 (similar to CHONDROMODULIN-1) | 1316 | 93 |
| 388 | 6438 | AK001444 | *Homo sapiens* unnamed protein product | 943 | 100 |
| 389 | 6441 | AL022237 | *Homo sapiens* bK1191B2.3 (PUTATIVE novel Acyl Transferase similar to *C. elegans* C50D2.7) (isoform 1)) | 2030 | 100 |
| 390 | 6446 | AJ006266 | *Homo sapiens* AND-1 protein | 5942 | 100 |
| 391 | 6454 | AL110240 | *Homo sapiens* hypothetical protein | 704 | 98 |
| 392 | 6459 | AL050149 | *Homo sapiens* hypothetical protein | 2899 | 100 |
| 393 | 6460 | AL096772 | *Homo sapiens* dJ365O12.1 (KIAA0758 protein) | 7049 | 99 |
| 394 | 6461 | AB008376 | *Sus scrofa* 17-kDa PKC-potentiated inhibitory protein of PP1 | 689 | 91 |
| 395 | 6467 | M22334 | *Homo sapiens* unknown protein | 796 | 59 |
| 396 | 6468 | AK002144 | *Homo sapiens* unnamed protein product | 2719 | 100 |
| 397 | 6487 | AL117429 | *Homo sapiens* hypothetical protein | 1077 | 100 |
| 398 | 6491 | AB027004 | *Homo sapiens* protein phosphatase | 435 | 48 |
| 399 | 6506 | AL137013 | *Homo sapiens* bA311P8.3 (probable uracil phosphoribosyltranferase) | 862 | 100 |
| 400 | 6513 | AL080141 | *Homo sapiens* hypothetical protein | 4793 | 99 |
| 401 | 6514 | AB035123 | *Mus musculus* GD1 alpha/GT1a alpha/GQ1b alpha synthase | 1696 | 93 |
| 402 | 6519 | K02882 | *Homo sapiens* immunoglobulin delta-chain | 2048 | 100 |
| 403 | 6521 | X07979 | *Homo sapiens* integrin beta 1 subunit precursor | 4347 | 99 |
| 404 | 6532 | AJ224819 | *Homo sapiens* tumor suppressor | 2149 | 99 |
| 405 | 6536 | Y07595 | *Homo sapiens* transcription factor TFIIH | 2373 | 100 |
| 406 | 6543 | D14479 | *Rattus norvegicus* calpain | 1428 | 88 |
| 407 | 6544 | AF161341 | *Homo sapiens* HSPC078 | 1097 | 98 |
| 408 | 6548 | AF187318 | *Homo sapiens* F-box protein Fbx2 | 1607 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 409 | 6551 | AL050369 | *Homo sapiens* hypothetical protein | 2495 | 99 |
| 410 | 6551 | AL050369 | *Homo sapiens* hypothetical protein | 2135 | 99 |
| 411 | 6552 | AF003785 | *Drosophila melanogaster* CG12792 gene product | 1211 | 56 |
| 412 | 6554 | AF091083 | *Homo sapiens* unknown | 1514 | 100 |
| 413 | 6556 | AK001708 | *Homo sapiens* unnamed protein product | 2334 | 99 |
| 414 | 6560 | AE003602 | *Drosophila melanogaster* CG2109 gene product | 462 | 38 |
| 415 | 6563 | AB011139 | *Homo sapiens* KIAA0567 protein | 4966 | 99 |
| 416 | 6564 | AK001177 | *Homo sapiens* unnamed protein product | 1933 | 100 |
| 417 | 6567 | D63484 | *Homo sapiens* The KIAA0150 gene product is novel. | 4951 | 99 |
| 418 | 6573 | AB029012 | *Homo sapiens* KIAA1089 protein | 5128 | 100 |
| 419 | 6575 | AL035461 | *Homo sapiens* dJ967N21.6 (novel CDP-alcohol phosphatidyltransferase family member protein) | 1562 | 98 |
| 420 | 6577 | AK001236 | *Homo sapiens* unnamed protein product | 1676 | 99 |
| 421 | 6593 | AF079098 | *Homo sapiens* arginine-tRNA-protein transferase 1-lp; ATE1-lp | 2733 | 99 |
| 422 | 6595 | AJ131712 | *Homo sapiens* nucleolar RNA-helicase | 2793 | 100 |
| 423 | 6599 | AJ133115 | *Homo sapiens* TSC-22-like protein | 2054 | 99 |
| 424 | 6625 | X98258 | *Homo sapiens* M-phase phosphoprotein 9 | 953 | 100 |
| 425 | 6625 | X98258 | *Homo sapiens* M-phase phosphoprotein 9 | 564 | 75 |
| 426 | 6626 | U97191 | *Caenorhabditis elegans* strong similarity to the YPT1 sub-family of RAS proteins | 960 | 85 |
| 427 | 6630 | X76057 | *Homo sapiens* phosphomannose isomerase | 2191 | 100 |
| 428 | 6631 | AE003559 | *Drosophila melanogaster* CG8605 gene product | 650 | 31 |
| 429 | 6632 | X97064 | *Homo sapiens* Sec23 protein | 4034 | 99 |
| 430 | 6633 | AF161401 | *Homo sapiens* HSPC283 | 779 | 100 |
| 431 | 6634 | AJ005642 | *Rattus rattus* serine protease | 717 | 48 |
| 432 | 6638 | M19529 | *Sus scrofa* follistatin A | 1906 | 98 |
| 433 | 6641 | AJ249457 | *Trichomonas vaginalis* centrin, putative | 183 | 28 |
| 434 | 6644 | AC004410 | *Homo sapiens* fos39554_1 | 2094 | 100 |
| 435 | 6646 | AK000096 | *Homo sapiens* unnamed protein product | 2157 | 99 |
| 436 | 6648 | AF252284 | *Homo sapiens* transcription specificity factor Sp1 | 4005 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 437 | 6652 | Z92825 | *Caenorhabditis elegans* predicted using Genefinder~cDNA EST yk315e12.3 comes from this gene~cDNA EST yk315e12.5 comes from this gene~cDNA EST yk605b12.3 comes from this gene | 541 | 43 |
| 438 | 6654 | D79205 | *Homo sapiens* ribosomal protein L39 | 160 | 77 |
| 439 | 6657 | AL031027 | Unknown/ prediction = (method: "" genefinder"", version: ""084"", score: ""67.72"") ~/pred iction = (method | 584 | 58 |
| 440 | 6658 | S49657 | *Mus sp.* mitochondrial capsule selenoprotein; MCS | 91 | 35 |
| 441 | 6663 | M26312 | *Oryctolagus cuniculus* unknown protein | 82 | 30 |
| 442 | 6664 | L32162 | *Homo sapiens* transcription factor | 574 | 80 |
| 443 | 6668 | AL050060 | *Homo sapiens* hypothetical protein | 526 | 99 |
| 444 | 6669 | AF205936 | *Mus musculus* ADP-ribosylation factor-like membrane-associated protein | 296 | 39 |
| 445 | 6673 | AK000387 | *Homo sapiens* unnamed protein product | 1136 | 100 |
| 446 | 6685 | U38934 | *Gallus gallus* histone H2A | 625 | 97 |
| 447 | 6687 | U76374 | *Mus musculus* skm-B0P2 | 602 | 31 |
| 448 | 6689 | X13403 | *Homo sapiens* Oct-1 protein (AA 1–743) | 3626 | 100 |
| 449 | 6693 | AB023139 | *Homo sapiens* KIAA0922 protein | 4258 | 100 |
| 450 | 6698 | AE003467 | *Drosophila melanogaster* CG7047 gene product | 274 | 27 |
| 451 | 6699 | AL049176 | *Homo sapiens* dA141H5.1 (C-terminal part of a Chordin LIKE protein with von Willebrand factor type C domains) | 1401 | 99 |
| 452 | 6705 | X92475 | *Homo sapiens* ITBA1 | 1429 | 100 |
| 453 | 6711 | Y16752 | *Homo sapiens* secretagogin | 1422 | 99 |
| 454 | 6713 | X51416 | *Homo sapiens* hormone receptor hERR1 (AA 1–521) | 2641 | 97 |
| 455 | 6716 | AJ006591 | *Homo sapiens* cysteine-rich protein | 1793 | 100 |
| 456 | 6725 | A08695 | *Homo sapiens* rap2 | 935 | 100 |
| 457 | 6726 | Z12173 | *Homo sapiens* N-acetylglucosamine-6-sulphatase | 2970 | 100 |
| 458 | 6727 | AL355092 | *Homo sapiens* hypothetical protein | 924 | 98 |
| 459 | 6730 | AB007930 | *Homo sapiens* KIAA0461 perotein | 7164 | 100 |
| 460 | 6730 | AB007930 | *Homo sapiens* KIAA0461 perotein | 6960 | 99 |
| 461 | 6730 | AB007930 | *Homo sapiens* KIAA0461 perotein | 6018 | 89 |
| 462 | 6732 | D38491 | *Homo sapiens* KIAA0117 | 1119 | 99 |
| 463 | 6733 | AJ012590 | *Homo sapiens* glucose 1-dehydrogenase | 4155 | 99 |
| 464 | 6737 | AL080133 | *Homo sapiens* hypothetical protein | 5677 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 465 | 6745 | Z75532 | *Caenorhabditis elegans* similar to mitochrondrial carrier protein~cDNA EST yk264h5.5 comes from this gene | 220 | 35 |
| 466 | 6751 | AF207829 | *Homo sapiens* SCAN-related protein RAZ1 | 900 | 100 |
| 467 | 6754 | AF061262 | *Mus musculus* semaF cytoplasmic domain associated protein 2 | 1316 | 83 |
| 468 | 6758 | AF220189 | *Homo sapiens* uncharacterized hypothalamus protein HBEX2 | 605 | 89 |
| 469 | 6761 | AL079292 | *Homo sapiens* hypothetical protein, similar to (AC007017) putative RNA helicase A | 4135 | 100 |
| 470 | 6765 | Z22819 | *Mus musculus* Rab24 protein | 1042 | 98 |
| 471 | 6768 | Z97029 | *Homo sapiens* ribonuclease HI large subunit | 1548 | 99 |
| 472 | 6773 | AB035384 | *Homo sapiens* SRp25 nuclear protein | 962 | 94 |
| 473 | 6776 | AF024631 | *Homo sapiens* ANG2 | 2644 | 100 |
| 474 | 6796 | AJ006710 | *Rattus norvegicus* phosphatidylinositol 3-kinase | 4508 | 97 |
| 475 | 6798 | AL137275 | *Homo sapiens* hypothetical protein | 4310 | 100 |
| 476 | 6823 | V00638 | bacteriophage lambda reading frame ea10 | 600 | 100 |
| 477 | 6825 | AF049103 | *Homo sapiens* Huntingtin interacting protein | 819 | 100 |
| 478 | 6826 | U50312 | *Caenorhabditis elegans* strong similarity to the a portion of the triple-helical region of collagen alpha chain | 92 | 40 |
| 479 | 6839 | Z26317 | *Homo sapiens* desmoglein 2 | 4810 | 99 |
| 480 | 6844 | AF227899 | *Homo sapiens* breast carcinoma-associated antigen isoform I | 4443 | 99 |
| 481 | 6847 | AF106037 | *Homo sapiens* adipocyte-derived leucine aminopeptidase | 4905 | 99 |
| 482 | 6849 | U15155 | *Gallus gallus* trypsinogen | 372 | 37 |
| 483 | 6854 | D86974 | *Homo sapiens* KIAA0220 | 2870 | 99 |
| 484 | 6857 | AF112201 | *Homo sapiens* neuronal protein NP25 | 1053 | 100 |
| 485 | 6861 | AF234765 | *Rattus norvegicus* serine-arginine-rich splicing regulatory protein SRRP86 | 958 | 64 |
| 486 | 6873 | AF117383 | *Homo sapiens* placental protein 13; PP13 | 502 | 68 |
| 487 | 6875 | AK002059 | *Homo sapiens* unnamed protein product | 1665 | 100 |
| 488 | 6877 | AE003438 | *Drosophila melanogaster* CG3184 gene product | 338 | 43 |
| 489 | 6880 | AK000101 | *Homo sapiens* unnamed protein product | 814 | 100 |
| 490 | 6885 | AK000609 | *Homo sapiens* unnamed protein product | 1160 | 100 |
| 491 | 6890 | AB023201 | *Homo sapiens* KIAA0984 protein | 3743 | 98 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 492 | 6890 | AB023201 | *Homo sapiens* KIAA0984 protein | 2361 | 97 |
| 493 | 6894 | AB013885 | *Homo sapiens* beta-ureidopropionase | 1494 | 100 |
| 494 | 6901 | AL096725 | *Homo sapiens* hypothetical protein | 1901 | 100 |
| 495 | 6904 | AK001901 | *Homo sapiens* unnamed protein product | 2212 | 99 |
| 496 | 6907 | AF226077 | *Homo sapiens* CHRAC17 | 724 | 99 |
| 497 | 6914 | AE003762 | *Drosophila melanogaster* CG5590 gene product | 646 | 75 |
| 498 | 6917 | Z73497 | *Homo sapiens* cU240C2.2 (Core histone H2A/H2B/H3/H4) | 324 | 100 |
| 499 | 6923 | Z83246 | *Caenorhabditis elegans* predicted using Genefinder~cDNA EST EMBL:M79771 comes from this gene | 891 | 60 |
| 500 | 6929 | X16282 | *Homo sapiens* zinc finger protein (217 AA) (1 is 2nd base in codon) | 1109 | 99 |
| 501 | 6931 | Z92539 | *Mycobacterium tuberculosis* pth | 300 | 36 |
| 502 | 6935 | M62324 | *Homo sapiens* modulator recognition factor I | 2902 | 96 |
| 503 | 6940 | AC024762 | *Caenorhabditis elegans* Hypothetical protein Y38F2AL.f | 434 | 43 |
| 504 | 6945 | AL117555 | *Homo sapiens* hypothetical protein | 321 | 94 |
| 505 | 6946 | AC005328 | *Homo sapiens* R26660_2, partial CDS | 865 | 97 |
| 506 | 6947 | AF151075 | *Homo sapiens* HSPC241 | 686 | 98 |
| 507 | 6949 | L34807 | *Musca domestica* transposase | 174 | 21 |
| 508 | 6959 | AJ271091 | *Homo sapiens* B-ind1 protein | 494 | 42 |
| 509 | 6960 | AK001348 | *Homo sapiens* unnamed protein product | 1853 | 99 |
| 510 | 6962 | AJ006692 | *Homo sapiens* ultra high sulfer keratin | 693 | 74 |
| 511 | 6963 | U23037 | *Oryctolagus cuniculus* eIF-2Bepsilon | 3406 | 90 |
| 512 | 6967 | AL136571 | *Homo sapiens* hypothetical protein | 413 | 58 |
| 513 | 6983 | AF151800 | *Homo sapiens* CGI-41 protein | 84 | 35 |
| 514 | 6988 | AF198100 | Fowlpox virus ORF FPV114 HAL3 domain | 567 | 54 |
| 515 | 6996 | AL137764 | *Homo sapiens* hypothetical protein | 2162 | 100 |
| 516 | 7003 | AB011792 | *Homo sapiens* extracellular matrix protein | 274 | 35 |
| 517 | 7016 | AB011542 | *Homo sapiens* MEGF9 | 2097 | 100 |
| 518 | 7017 | AL096744 | *Homo sapiens* hypothetical protein | 231 | 68 |
| 519 | 7025 | AF119664 | *Homo sapiens* transcriptional regulator protein HCNGP | 1574 | 100 |
| 520 | 7025 | AF119664 | *Homo sapiens* transcriptional regulator protein HCNGP | 1144 | 89 |
| 521 | 7025 | AF119664 | *Homo sapiens* transcriptional regulator protein HCNGP | 1448 | 94 |
| 522 | 7050 | X12517 | *Homo sapiens* C protein (AA 1–159) | 918 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 523 | 7051 | AL079277 | Homo sapiens hypothetical protein, similar to (U32865) linotte protein | 1294 | 100 |
| 524 | 7055 | AF067730 | Homo sapiens TLS-associated protein TASR-2 | 631 | 57 |
| 525 | 7060 | U27831 | Homo sapiens striatum-enriched phosphatase | 2840 | 98 |
| 526 | 7064 | L26288 | Rattus norvegicus CaM-like protein kinase | 1416 | 82 |
| 527 | 7067 | AL032684 | Schizosaccharomyces pombe hypothetical protein | 300 | 37 |
| 528 | 7071 | AL050028 | Homo sapiens hypothetical protein | 671 | 100 |
| 529 | 7072 | X78444 | Rattus norvegicus ribosomal protein L22 | 450 | 73 |
| 530 | 7073 | U27838 | Mus musculus glycosyl-phosphatidyl-inositol-anchored protein homolog | 3305 | 96 |
| 531 | 7076 | AB037807 | Homo sapiens KIAA1386 protein | 4001 | 99 |
| 532 | 7088 | AJ276504 | Mus musculus phosphorylated adaptor for RNA export | 1705 | 85 |
| 533 | 7089 | AB033079 | Homo sapiens KIAA1253 protein | 2398 | 100 |
| 534 | 7091 | U41315 | Homo sapiens ZNF127-Xp | 2458 | 93 |
| 535 | 7091 | AF192784 | Homo sapiens makorin 1 | 2062 | 97 |
| 536 | 7104 | AE003704 | Drosophila melanogaster CG3307 gene product | 510 | 44 |
| 537 | 7105 | Z22968 | Homo sapiens M130 antigen | 6205 | 100 |
| 538 | 7105 | Z22971 | Homo sapiens M130 antigen extracellular variant | 6380 | 100 |
| 539 | 7109 | AL050225 | Homo sapiens hypothetical protein | 1431 | 99 |
| 540 | 7109 | AL050225 | Homo sapiens hypothetical protein | 932 | 99 |
| 541 | 7119 | Z46522 | Drosophila subobscura bcn92 | 237 | 55 |
| 542 | 7120 | AE003771 | Drosophila melanogaster CG1972 gene product | 2185 | 68 |
| 543 | 7121 | AL021546 | Homo sapiens Cytochrome C Oxidase Polypeptide VIa-liver precursor (EC 1.9.3.1) | 593 | 100 |
| 544 | 7126 | L02956 | Xenopus laevis ribonucleoprotein | 1664 | 87 |
| 545 | 7127 | AF201947 | Homo sapiens MEK binding partner 1 | 616 | 100 |
| 546 | 7130 | L31783 | Mus musculus uridine kinase | 1266 | 92 |
| 547 | 7131 | AK001534 | Homo sapiens unnamed protein product | 652 | 97 |
| 548 | 7144 | AE003834 | Drosophila melanogaster CG8026 gene product | 485 | 57 |
| 549 | 7159 | AF154108 | Homo sapiens tumor necrosis factor type 1 receptor associated protein | 3559 | 99 |
| 550 | 7163 | AE003066 | Drosophila melanogaster CG13865 gene product | 251 | 34 |
| 551 | 7175 | X57807 | Homo sapiens immunoglobulin lambda light chain | 699 | 91 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 552 | 7188 | AL031673 | Homo sapiens dJ694B14.1 (PUTATIVE novel KRAB box protein with 18 C2H2 type Zinc finger domains) | 4066 | 99 |
| 553 | 7189 | Y11652 | Homo sapiens phosphate cyclase | 238 | 100 |
| 554 | 7190 | AF192968 | Homo sapiens high-glucose-regulated protein 8 | 3041 | 99 |
| 555 | 7191 | AB020648 | Homo sapiens KIAA0841 protein | 3237 | 99 |
| 556 | 7203 | AL031427 | Homo sapiens dJ167A19.1 (novel protein) | 1608 | 100 |
| 557 | 7204 | AF151534 | Homo sapiens core histone macroH2A2.2 | 1866 | 100 |
| 558 | 7208 | AL021331 | Homo sapiens dJ366N23.1 (putative C. elegans UNC-93 (protein 1, C46F11.1) LIKE protein) | 1129 | 100 |
| 559 | 7209 | X14608 | Homo sapiens propionyl-COA carboxylase | 3579 | 100 |
| 560 | 7210 | AL110249 | Homo sapiens hypothetical protein | 4488 | 99 |
| 561 | 7216 | AC004982 | Homo sapiens similar to yeast hypothetical protein ybk4; similar to P38164 (PID:g586461) | 2038 | 100 |
| 562 | 7221 | AE003628 | Drosophila melanogaster CG5676 gene product | 148 | 30 |
| 563 | 7230 | AE003519 | Drosophila melanogaster CG4108 gene product | 711 | 75 |
| 564 | 7237 | X79417 | Sus scrofa 40S ribosomal protein S12 | 687 | 100 |
| 565 | 7240 | AB023203 | Homo sapiens KIAA0986 protein | 7551 | 100 |
| 566 | 7245 | AE003684 | Drosophila melanogaster CG8412 gene product | 1106 | 51 |
| 567 | 7250 | AL117662 | Homo sapiens hypothetical protein | 1078 | 99 |
| 568 | 7251 | AB041261 | Homo sapiens calcium-independent phospholipase A2 | 2903 | 100 |
| 569 | 7255 | AK000812 | Homo sapiens unnamed protein product | 1350 | 100 |
| 570 | 7260 | Y10936 | Homo sapiens hypothetical protein | 1104 | 99 |
| 571 | 7265 | AK000444 | Homo sapiens unnamed protein product | 2900 | 99 |
| 572 | 7268 | AK001798 | Homo sapiens unnamed protein product | 1460 | 99 |
| 573 | 7275 | AL117635 | Homo sapiens hypothetical protein | 929 | 99 |
| 574 | 7279 | M55531 | Homo sapiens GLUT5 protein | 924 | 45 |
| 575 | 7283 | AL117573 | Homo sapiens hypothetical protein | 2907 | 99 |
| 576 | 7283 | AL117573 | Homo sapiens hypothetical protein | 2457 | 97 |
| 577 | 7287 | AF237631 | Homo sapiens ubiquitous tropomodulin U-Tmod | 1798 | 100 |
| 578 | 7301 | AF090929 | Homo sapiens PRO0477p | 653 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 579 | 7308 | AL031228 | Homo sapiens dJ1033B10.2 (WD40 protein BING4 (similar to S. cerevisiae YER082C, M. sexta MNG10 and C. elegans F28D1.1) | 3196 | 100 |
| 580 | 7308 | AL031228 | Homo sapiens dJ1033B10.2 (WD40 protein BING4 (similar to S. cerevisiae YER082C, M. sexta MNG10 and C. elegans F28D1.1) | 2825 | 96 |
| 581 | 7309 | AF171102 | Homo sapiens retinal degeneration B beta | 1302 | 95 |
| 582 | 7319 | AK001598 | Homo sapiens unnamed protein product | 2775 | 100 |
| 583 | 7320 | AJ237946 | Homo sapiens DEAD Box Protein 5 | 2443 | 100 |
| 584 | 7326 | Z97184 | Homo sapiens HKE2 | 624 | 100 |
| 585 | 7326 | Z97184 | Homo sapiens HKE2 | 409 | 98 |
| 586 | 7334 | AJ245587 | Homo sapiens Kruppel-type zinc finger | 1942 | 100 |
| 587 | 7337 | Z22820 | Canis familiaris Rab22a protein | 995 | 98 |
| 588 | 7339 | X64701 | Haloferax mediterranei gvpI | 103 | 28 |
| 589 | 7344 | L04733 | Homo sapiens kinesin light chain | 1936 | 72 |
| 590 | 7355 | AB020681 | Homo sapiens KIAA0874 protein | 3090 | 100 |
| 591 | 7363 | M55542 | Homo sapiens guanylate binding protein isoform I | 2993 | 98 |
| 592 | 7363 | M55542 | Homo sapiens guanylate binding protein isoform I | 2901 | 96 |
| 593 | 7365 | U41857 | Xenopus laevis WD-40 motifs; up-regulated by thyroid hormone in tadpoles | 937 | 53 |
| 594 | 7368 | M26285 | Xenopus laevis myc protein | 82 | 28 |
| 595 | 7369 | AB029150 | Homo sapiens KRAB zinc finger protein HFB101L | 2196 | 100 |
| 596 | 7372 | AK000706 | Homo sapiens unnamed protein product | 1641 | 100 |
| 597 | 7373 | AB041648 | Mus musculus unnamed protein product | 625 | 100 |
| 598 | 7374 | AB032976 | Homo sapiens KIAA1150 protein | 1929 | 100 |
| 599 | 7375 | AB011182 | Homo sapiens KIAA0610 protein | 3467 | 100 |
| 600 | 7381 | AJ243721 | Homo sapiens dTDP-4-keto-6-deoxy-D-glucose 4-reductase | 1710 | 100 |
| 601 | 7383 | Z46676 | Caenorhabditis elegans cDNA EST yk484g1.3 comes from this gene~cDNA EST yk484g1.5 comes from this gene | 312 | 40 |
| 602 | 7387 | L24804 | Homo sapiens p23 | 350 | 43 |
| 603 | 7391 | AK000453 | Homo sapiens unnamed protein product | 1843 | 99 |
| 604 | 7393 | D50807 | Bos taurus synaphin | 146 | 35 |
| 605 | 7395 | M23159 | Cricetus cricetus DHFR-coamplified protein | 163 | 31 |
| 606 | 7397 | AB020684 | Homo sapiens KIAA0877 protein | 3034 | 100 |
| 607 | 7399 | AK002205 | Homo sapiens unnamed protein product | 1331 | 97 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 608 | 7405 | AL096779 | Homo sapiens hypothetical protein | 1544 | 100 |
| 609 | 7406 | AL161495 | Arabidopsis thaliana putative WD-repeat protein | 866 | 43 |
| 610 | 7406 | AL161495 | Arabidopsis thaliana putative WD-repeat protein | 442 | 36 |
| 611 | 7409 | U97001 | Caenorhabditis elegans similar to Schizosaccharomyces pombe 4-nitrophenylphosphatase (PNPPASE) (GB:X62722, NID:g5005) | 605 | 52 |
| 612 | 7410 | X71978 | Mus musculus Fif | 1503 | 95 |
| 613 | 7411 | AL117526 | Homo sapiens hypothetical protein | 4375 | 99 |
| 614 | 7417 | AL031765 | Unknown/ prediction = (method: "" genefinder"", version: ""084"", score: ""31.96"") ~/pred iction = (method | 364 | 35 |
| 615 | 7418 | AK001743 | Homo sapiens unnamed protein product | 2248 | 99 |
| 616 | 7421 | AE003557 | Drosophila melanogaster CG7388 gene product | 471 | 39 |
| 617 | 7422 | AJ224326 | Homo sapiens ribulose-5-phosphate-epimerase | 912 | 100 |
| 618 | 7422 | AE003840 | Drosophila melanogaster CG1364 gene product | 363 | 60 |
| 619 | 7423 | AB023191 | Homo sapiens KIAA0974 protein | 2953 | 100 |
| 620 | 7424 | AE003750 | Drosophila melanogaster CG11839 gene product | 201 | 31 |
| 621 | 7426 | AJ276485 | Homo sapiens integral membrane transporter protein | 1200 | 100 |
| 622 | 7427 | AK000062 | Homo sapiens unnamed protein product | 1390 | 63 |
| 623 | 7428 | AB026808 | Mus musculus synaptotagmin XI | 2142 | 95 |
| 624 | 7430 | AB015345 | Homo sapiens HRIHFB2216 | 2601 | 99 |
| 625 | 7435 | X65724 | Homo sapiens ORF2 | 498 | 100 |
| 626 | 7437 | AE003474 | Drosophila melanogaster CGT275 gene product | 489 | 43 |
| 627 | 7439 | AK002204 | Homo sapiens unnamed protein product | 1138 | 100 |
| 628 | 7440 | AK001675 | Homo sapiens unnamed protein product | 1289 | 100 |
| 629 | 7442 | AC006978 | Homo sapiens supported by human and rodent ESTs; match to AA454028 (NID:g2167697), similar to AA9255224 (NID:g4236415) and AA023712 (NID:g1487627) | 501 | 100 |
| 630 | 7450 | AF129756 | Homo sapiens G5c | 273 | 100 |
| 631 | 7451 | M23765 | Rattus norvegicus alpha - tropomyosin | 133 | 96 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 632 | 7452 | Z80220 | *Caenorhabditis elegans* Similarity to yeast protein TREMBL ID E246895)~cDNA EST EMBL:T00018 comes from this gene~cDNA EST EMBL:C13908 comes from this gene~cDNA EST EMBL:C11656 comes from this gene~cDNA EST yk234a5.3 comes from this gene~cDNA EST yk234a5.5 comes from this gene~cDNA EST yk590h6.3 comes from this gene | 601 | 57 |
| 633 | 7454 | AL117530 | *Homo sapiens* hypothetical protein | 2121 | 99 |
| 634 | 7457 | AF055473 | *Homo sapiens* GAGE-8 | 273 | 52 |
| 635 | 7459 | AL050147 | *Homo sapiens* hypothetical protein | 2847 | 100 |
| 636 | 7461 | AF143956 | *Mus musculus* coronin-2 | 2300 | 93 |
| 637 | 7463 | AK002072 | *Homo sapiens* unnamed protein product | 1858 | 98 |
| 638 | 7466 | AF060076 | *Mus musculus* polyhomeotic 2 protein | 147 | 45 |
| 639 | 7469 | Z98944 | *Schizosaccharomyces pombe* hypothetical protein | 159 | 44 |
| 640 | 7473 | U66208 | *Ascaris suum* AsSLR8.60 | 128 | 54 |
| 641 | 7481 | AK000337 | *Homo sapiens* unnamed protein product | 1319 | 62 |
| 642 | 7482 | U09410 | *Homo sapiens* zinc finger protein ZNF131 | 2483 | 99 |
| 643 | 7482 | U09410 | *Homo sapiens* zinc finger protein ZNF131 | 1853 | 99 |
| 644 | 7483 | AF068302 | *Homo sapiens* choline/ethanolamineph osphotransferase | 1356 | 66 |
| 645 | 7485 | AK000427 | *Homo sapiens* unnamed protein product | 1140 | 100 |
| 646 | 7486 | U54807 | *Rattus norvegicus* GTP-binding protein | 1167 | 97 |
| 647 | 7487 | AF058807 | *Bos taurus* GTP-binding protein rah | 606 | 97 |
| 648 | 7491 | AL050269 | *Homo sapiens* hypothetical protein | 1066 | 99 |
| 649 | 7492 | AE003652 | *Drosophila melanogaster* CG13284 gene product | 587 | 40 |
| 650 | 7494 | AE003526 | *Drosophila melanogaster* CG4098 gene product | 753 | 51 |
| 651 | 7498 | AB033045 | *Homo sapiens* KIAA1219 protein | 2674 | 99 |
| 652 | 7504 | X61381 | *Rattus rattus* interferon-induced protein | 202 | 46 |
| 653 | 7508 | D38169 | *Homo sapiens* inositol 1,4,5-trisphosphate 3-kinase isoenzyme | 3278 | 100 |
| 654 | 7516 | AL031432 | *Homo sapiens* dJ465N24.2.1 (PUTATIVE novel protein) (isoform 1) | 893 | 100 |
| 655 | 7518 | U79275 | *Homo sapiens* unknown | 611 | 100 |
| 656 | 7519 | AJ011306 | Homosapiens guanine nucleotide exchange factor (long isoform) | 2752 | 99 |
| 657 | 7521 | AL355775 | *Arabidopsis thaliana* putative protein | 368 | 48 |
| 658 | 7529 | AF116827 | *Homo sapiens* unknown | 3020 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 659 | 7532 | AE003795 | *Drosophila melanogaster* CG15120 gene product | 630 | 59 |
| 660 | 7533 | AB031292 | *Mus musculus* proteolipid protein 2 | 130 | 31 |
| 661 | 7535 | U25801 | *Homo sapiens* Tax1 binding protein | 852 | 98 |
| 662 | 7545 | AF049523 | *Homo sapiens* huntingtin-interacting protein HYPA/FBP11 | 1390 | 97 |
| 663 | 7546 | AK001809 | *Homo sapiens* unnamed protein product | 1040 | 100 |
| 664 | 7552 | AF028823 | *Homo sapiens* Tax interaction protein 1 | 581 | 100 |
| 665 | 7554 | AE003467 | *Drosophila melanogaster* CG13880 gene product | 262 | 41 |
| 666 | 7567 | U94991 | *Xenopus laevis* transcription factor XLMO1 | 795 | 97 |
| 667 | 7569 | S73775 | *Homo sapiens* calmitine; calsequestrine | 2029 | 100 |
| 668 | 7575 | AE003579 | *Drosophila melanogaster* CG17593 gene product | 1023 | 45 |
| 669 | 7576 | AJ243191 | *Homo sapiens* heat shock protein | 827 | 96 |
| 670 | 7577 | X65020 | *Bos taurus* PSST subunit of the NADH: ubiquinone oxidoreductase complex | 964 | 86 |
| 671 | 7579 | AE003731 | *Drosophila melanogaster* CG10877 gene product | 495 | 49 |
| 672 | 7582 | Z30093 | *Homo sapiens* basic transcription factor 2, 35 kD subunit | 1576 | 99 |
| 673 | 7587 | AB030835 | *Homo sapiens* contains two glutamine rich domains, three zinc-finger domains, and matrin 3 homologous domain 3 (MH3) | 4697 | 99 |
| 674 | 7589 | AB023222 | *Homo sapiens* KIAA1005 protein | 5410 | 100 |
| 675 | 7597 | AL022238 | *Homo sapiens* dJ1042K10.2 (supported by GENSCAN, FGENES and GENEWISE) | 4048 | 99 |
| 676 | 7597 | AL022238 | *Homo sapiens* dJ1042K10.2 (supported by GENSCAN, FGENES and GENEWISE) | 2321 | 99 |
| 677 | 7609 | AL117237 | *Homo sapiens* hypothetical protein | 4820 | 99 |
| 678 | 7609 | AK000726 | *Homo sapiens* unnamed protein product | 3767 | 96 |
| 679 | 7609 | AK000726 | *Homo sapiens* unnamed protein product | 3227 | 92 |
| 680 | 7613 | AL023859 | *Schizosaccharomyces pombe* trna-splicing endonuclease subunit | 172 | 42 |
| 681 | 7623 | AC005023 | *Homo sapiens* match to EST AA361117 (NID:g2013436) | 789 | 100 |
| 682 | 7629 | AC005253 | *Homo sapiens* R26445_1 | 902 | 100 |
| 683 | 7630 | AF151070 | *Homo sapiens* HSPC236 | 951 | 98 |
| 684 | 7633 | AF103801 | *Homo sapiens* unknown | 2555 | 100 |
| 685 | 7635 | AC004000 | *Homo sapiens* match to EST AA085966 (NID:g1629547) | 388 | 100 |
| 686 | 7638 | AK001712 | *Homo sapiens* unnamed protein product | 1586 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 687 | 7639 | M24103 | Bos taurus translocase | 1512 | 97 |
| 688 | 7646 | D79990 | Homo sapiens KIAA0168 | 899 | 60 |
| 689 | 7647 | AF208844 | Homo sapiens BM-002 | 428 | 100 |
| 690 | 7648 | AL023496 | Streptomyces coelicolor A3 (2) hypothetical protein | 163 | 35 |
| 691 | 7658 | AL031431 | Homo sapiens dJ462023.2 (novel protein) | 2058 | 100 |
| 692 | 7664 | S45367 | Canis familiaris centractin | 1949 | 100 |
| 693 | 7664 | S45367 | Canis familiaris centractin | 1315 | 98 |
| 694 | 7672 | U88573 | Homo sapiens NBR2 | 566 | 92 |
| 695 | 7674 | D43950 | Homo sapiens KIAA0098 protein | 2732 | 100 |
| 696 | 7675 | AE003708 | Drosophila melanogaster CG5038 gene product | 930 | 40 |
| 697 | 7676 | AL080125 | Homo sapiens hypothetical protein | 3002 | 100 |
| 698 | 7681 | AE003690 | Drosophila melanogaster CG14701 gene product | 276 | 67 |
| 699 | 7688 | AL080125 | Homo sapiens hypothetical protein | 3181 | 100 |
| 700 | 7693 | Z14000 | Homo sapiens RING1 | 2017 | 100 |
| 701 | 7694 | AC013289 | Arabidopsis thaliana hypothetical protein | 189 | 44 |
| 702 | 7715 | AB041607 | Mus musculus unnamed protein product | 2345 | 94 |
| 703 | 7716 | AF251041 | Homo sapiens SGC32445 protein | 535 | 70 |
| 704 | 7718 | AE003427 | Drosophila melanogaster CG10802 gene product | 527 | 51 |
| 705 | 7721 | AC012329 | Arabidopsis thaliana putative transporter | 690 | 38 |
| 706 | 7723 | X67250 | Rattus norvegicus n-chimaerin | 1710 | 97 |
| 707 | 7729 | U05784 | Rattus norvegicus light chain 3 subunit of microtubule-associated proteins 1A and 1B | 609 | 96 |
| 708 | 7733 | S77099 | Drosophila pseudoobscura Jan A | 276 | 48 |
| 709 | 7735 | AF060862 | Homo sapiens unknown | 638 | 96 |
| 710 | 7741 | AL133363 | Arabidopsis thaliana putative protein | 155 | 38 |
| 711 | 7743 | AB034912 | Homo sapiens WD-repeat like sequence | 2483 | 100 |
| 712 | 7748 | AF177145 | Homo sapiens mammalian inositol hexakisphosphate kinase 2 | 2232 | 99 |
| 713 | 7749 | X69910 | Homo sapiens P63 protein | 2958 | 99 |
| 714 | 7750 | U80736 | Homo sapiens CAGF9 | 1657 | 100 |
| 715 | 7757 | AC004997 | Homo sapiens match to ESTs AA667999 (NID:g2626700), AA165465 (NID:g1741481), Z45871 (NID:g575105), and T84026 (NID:g712314); similar to various tre-like proteins including: AF040654 (PID:g2746883), D13644 (PID:g2104571), AL0211483 (PID:g2815076) and Z797052 (PID:g2213552) | 2335 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 716 | 7759 | AK000504 | Homo sapiens unnamed protein product | 1045 | 100 |
| 717 | 7760 | AE003565 | Drosophila melanogaster CG12756 gene product | 345 | 48 |
| 718 | 7760 | AE003565 | Drosophila melanogaster CG12756 gene product | 345 | 48 |
| 719 | 7764 | AF193795 | Homo sapiens vacuolar sorting protein VPS29/PEP11 | 960 | 100 |
| 720 | 7765 | AJ222968 | Mus musculus L-periaxin | 120 | 30 |
| 721 | 7766 | AK001456 | Homo sapiens unnamed protein product | 4311 | 100 |
| 722 | 7767 | AE003431 | Drosophila melanogaster CG15912 gene product | 322 | 36 |
| 723 | 7769 | AK000505 | Homo sapiens unnamed protein product | 2190 | 100 |
| 724 | 7770 | AE003525 | Drosophila melanogaster CG7725 gene product | 383 | 42 |
| 725 | 7774 | U37251 | Homo sapiens Description: KRAB zinc finger protein; this is a splicing variant that contains a stop codon and frame shift between the KRAB box and the zinc finger region; Method: conceptual translation supplied by author | 196 | 44 |
| 726 | 7779 | AF233321 | Mus musculus zinc transporter like 1 | 1864 | 94 |
| 727 | 7781 | AE003790 | Drosophila melanogaster CG3450 gene product | 339 | 86 |
| 728 | 7782 | X95826 | Homo sapiens mono-ADP-ribosyltransferase | 1390 | 98 |
| 729 | 7783 | M12098 | Rattus norvegicus myosin heavy chain | 155 | 25 |
| 730 | 7787 | AF140683 | Mus musculus F-box protein FWD2 | 2397 | 98 |
| 731 | 7792 | AF151023 | Homo sapiens HSPC189 | 1104 | 100 |
| 732 | 7795 | AL117639 | Homo sapiens hypothetical protein | 1342 | 99 |
| 733 | 7801 | AB007829 | Homo sapiens CSR1 | 528 | 54 |
| 734 | 7807 | AJ243972 | Homo sapiens 6-phosphogluconolactonase | 1317 | 100 |
| 735 | 7808 | AB035863 | Homo sapiens ATP specific succinyl CoA synthetase beta subunit precursor | 2324 | 99 |
| 736 | 7819 | AB015339 | Homo sapiens HRIHFB2255 | 575 | 66 |
| 737 | 7824 | AF163825 | Homo sapiens pre-B lymphocyte protein 3 | 634 | 100 |
| 738 | 7826 | AF201949 | Homo sapiens 60S ribosomal protein L30 isolog | 868 | 100 |
| 739 | 7829 | AF060862 | Homo sapiens unknown | 236 | 85 |
| 740 | 7832 | AJ011373 | Homo sapiens hypothetical protein | 549 | 100 |
| 741 | 7839 | AL031778 | Homo sapiens dJ34B21.3 (PUTATIVE novel protein) | 421 | 100 |
| 742 | 7844 | AK000452 | Homo sapiens unnamed protein product | 1473 | 100 |
| 743 | 7847 | AK001851 | Homo sapiens unnamed protein product | 2711 | 99 |
| 744 | 7848 | AK000510 | Homo sapiens unnamed protein product | 1536 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 745 | 7853 | U89649 | *Chlamydomonas reinhardtii* Mr19,000 outer arm dynein light chain | 244 | 34 |
| 746 | 7854 | AL050008 | *Homo sapiens* hypothetical protein | 591 | 56 |
| 747 | 7856 | AJ009985 | *Homo sapiens* annexin 31 (annexin XXXI) | 1675 | 99 |
| 748 | 7862 | AL080097 | *Homo sapiens* hypothetical protein | 1363 | 100 |
| 749 | 7865 | AF224263 | *Heterodontus francisci* HoxD8 | 742 | 84 |
| 750 | 7874 | X63417 | *Homo sapiens* IRLB | 1037 | 100 |
| 751 | 7877 | AE003485 | *Drosophila melanogaster* CG11757 gene product | 622 | 53 |
| 752 | 7880 | AK001939 | *Homo sapiens* unnamed protein product | 2532 | 99 |
| 753 | 7882 | AF263614 | *Homo sapiens* acetyl-CoA synthetase | 3493 | 99 |
| 754 | 7884 | AF022977 | *Caenorhabditis elegans* contains similarity to leucine-rich repeats (LRR) | 177 | 36 |
| 755 | 7886 | AC006153 | *Homo sapiens* similar to *Aquifex aeolicus* GTP-binding protein; similar to AE000771 (PID:g2984292) | 662 | 98 |
| 756 | 7888 | AE003734 | *Drosophila melanogaster* CG3337 gene product | 416 | 47 |
| 757 | 7889 | AF110764 | *Mus musculus* RS21-C6 | 655 | 75 |
| 758 | 7901 | AE003459 | *Drosophila melanogaster* CG9848 gene product | 507 | 59 |
| 759 | 7910 | AF177476 | *Rattus norvegicus* CDK5 activator-binding protein | 1995 | 86 |
| 760 | 7911 | AL049946 | *Homo sapiens* hypothetical protein | 3091 | 99 |
| 761 | 7921 | AL121733 | *Homo sapiens* hypothetical protein | 314 | 39 |
| 762 | 7923 | AE003772 | *Drosophila melanogaster* CG15525 gene product | 299 | 46 |
| 763 | 7924 | AE003834 | *Drosophila melanogaster* BcDNA:GH08789 gene product | 710 | 42 |
| 764 | 7925 | U16307 | *Homo sapiens* glioma pathogenesis-related protein | 329 | 40 |
| 765 | 7928 | AF161457 | *Homo sapiens* HSPC339 | 571 | 100 |
| 766 | 7929 | AL050137 | *Homo sapiens* hypothetical protein | 2319 | 100 |
| 767 | 7930 | AF223466 | *Homo sapiens* HT015 protein | 831 | 66 |
| 768 | 7934 | AL132965 | *Arabidopsis thaliana* putative WD-40 repeat-protein | 286 | 30 |
| 769 | 7938 | AB024937 | *Homo sapiens* LUNX | 1284 | 100 |
| 770 | 7942 | Y14768 | *Homo sapiens* V-ATPase G-subunit like protein | 579 | 100 |
| 771 | 7945 | AL110235 | *Homo sapiens* hypothetical protein | 870 | 100 |
| 772 | 7946 | L13291 | *Homo sapiens* ADP-ribosylarginine hydrolase | 802 | 46 |
| 773 | 7948 | AK000771 | *Homo sapiens* unnamed protein product | 1067 | 99 |
| 774 | 7951 | AE003808 | *Drosophila melanogaster* CG8441 gene product | 319 | 54 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 775 | 7952 | X92814 | Homo sapiens homologous to rat HREV107 (ACC. NO. X76453) | 830 | 99 |
| 776 | 7953 | AF151638 | Homo sapiens phosphatidylcholine transfer protein | 1142 | 100 |
| 777 | 7954 | AF059531 | Homo sapiens protein arginine N-methyltransferase 3 | 2679 | 99 |
| 778 | 7957 | AF161392 | Homo sapiens HSPC274 | 370 | 79 |
| 779 | 7958 | AL050100 | Homo sapiens hypothetical protein | 165 | 53 |
| 780 | 7961 | AL117444 | Homo sapiens hypothetical protein | 1991 | 100 |
| 781 | 7965 | X83006 | Homo sapiens neutrophil gelatinase associated lipocalin | 208 | 40 |
| 782 | 7966 | U34973 | Mus musculus protein tyrosine phosphatase-like | 1131 | 95 |
| 783 | 7979 | M86510 | Schistosoma mansoni glutathione peroxidase | 327 | 43 |
| 784 | 7986 | AE000850 | Methanobacterium thermoautotrophicum transcriptional regulator | 407 | 55 |
| 785 | 7986 | AE000850 | Methanobacterium thermoautotrophicum transcriptional regulator | 406 | 55 |
| 786 | 7988 | AF161455 | Homo sapiens HSPC337 | 742 | 98 |
| 787 | 7991 | Z48795 | Caenorhabditis elegans similarity to a thioredoxin-like protein from Bacillus subtilis (Swiss Prot accession number P35160)~cDNA EST EMBL:D69151 comes from this gene~cDNA EST EMBL:D69212 comes from this gene~cDNA EST EMBL:D76199 comes from this gene~cDNA EST EMBL:D76335 comes from this gene~cDNA EST EMBL:D65648 comes from this gene~cDNA EST EMBL:D65690 comes from this gene~cDNA EST EMBL:D73198 comes from this gene~cDNA EST EMBL:D73307 comes from this gene~cDNA EST yk257e10.3 comes from this gene~cDNA EST yk257e10.5 comes from this gene~cDNA EST yk228e3.3 comes from this gene~cDNA EST yk228e3.5 comes from this gene~cDNA EST yk199h7.5 comes from this gene | 247 | 38 |
| 788 | 7992 | AJ005866 | Homo sapiens Sqv-7-like protein | 1321 | 99 |
| 789 | 7992 | AJ005866 | Homo sapiens Sqv-7-like protein | 1118 | 99 |
| 790 | 7992 | AJ005866 | Homo sapiens Sqv-7-like protein | 891 | 99 |
| 791 | 7992 | AJ005866 | Homo sapiens Sqv-7-like protein | 1016 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 792 | 8003 | AB040964 | Homo sapiens KIAA1531 protein | 337 | 31 |
| 793 | 8014 | AL117587 | Homo sapiens hypothetical protein | 902 | 100 |
| 794 | 8015 | AL031010 | Homo sapiens dJ422F24.1 (PUTATIVE novel protein similar to C. elegans C02C2.5) | 968 | 100 |
| 795 | 8016 | U28016 | Mus musculus parathion hydrolase (phosphotriesterase)-related protein | 1624 | 87 |
| 796 | 8017 | AK001704 | Homo sapiens unnamed protein product | 2207 | 99 |
| 797 | 8019 | AF117587 | Manduca sexta unknown | 348 | 71 |
| 798 | 8020 | AB018260 | Homo sapiens KIAA0717 protein | 3331 | 99 |
| 799 | 8022 | AE003446 | Drosophila melanogaster CG12121 gene product | 772 | 51 |
| 800 | 8022 | AE003446 | Drosophila melanogaster CG12121 gene product | 1074 | 52 |
| 801 | 8028 | AL137520 | Homo sapiens hypothetical protein | 2032 | 99 |
| 802 | 8030 | AF182076 | Homo sapiens glioma tumor suppressor candidate region protein 2 | 2418 | 100 |
| 803 | 8038 | AE003552 | Drosophila melanogaster CG3967 gene product | 388 | 43 |
| 804 | 8042 | AL159143 | Homo sapiens hypothetical protein | 1045 | 60 |
| 805 | 8045 | L40357 | Homo sapiens thyroid receptor interactor | 509 | 100 |
| 806 | 8045 | L40357 | Homo sapiens thyroid receptor interactor | 404 | 85 |
| 807 | 8046 | Y18503 | Homo sapiens XAP-5-like protein | 1672 | 100 |
| 808 | 8047 | AB041600 | Mus musculus unnamed protein product | 1053 | 87 |
| 809 | 8051 | AL049688 | Homo sapiens hypothetical protein | 2514 | 9B |
| 810 | 8059 | AK001355 | Homo sapiens unnamed protein product | 625 | 41 |
| 811 | 8064 | Z14122 | Xenopus laevis XLCL2 | 455 | 77 |
| 812 | 8069 | X67712 | Psychrobacter immobilis triacylglycerol lipase | 272 | 28 |
| 813 | 8074 | AB033105 | Homo sapiens KIAA1279 protein | 3221 | 99 |
| 814 | 8077 | AK001963 | Homo sapiens unnamed protein product | 952 | 100 |
| 815 | 8078 | AJ000217 | Homo sapiens CLIC2 | 1286 | 99 |
| 816 | 8079 | AB030505 | Mus musculus UBE-1c2 | 1069 | 79 |
| 817 | 8084 | AL080118 | Homo sapiens hypothetical protein | 738 | 96 |
| 818 | 8088 | AE003829 | Drosophila melanogaster CG11777 gene product | 641 | 71 |
| 819 | 8090 | AL023553 | Homo sapiens dJ347H13.4 (novel protein) | 557 | 100 |
| 820 | 8091 | AL109978 | Homo sapiens hypothetical protein | 1679 | 100 |
| 821 | 8099 | AE003839 | Drosophila melanogaster CG8722 gene product | 1037 | 58 |
| 822 | 8099 | AE003839 | Drosophila melanogaster CG8722 gene product | 678 | 53 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 823 | 8100 | AF180681 | Homo sapiens guanine nucleotide exchange factor | 3597 | 100 |
| 824 | 8102 | AK001433 | Homo sapiens unnamed protein product | 944 | 100 |
| 825 | 8103 | M62419 | Mus musculus clathrin-associated protein | 2189 | 99 |
| 826 | 8103 | AJ006219 | Drosophila melanogaster clathrin-associated protein | 1254 | 79 |
| 827 | 8104 | AB006191 | Mus musculus cornichon-like protein | 362 | 78 |
| 828 | 8108 | L03303 | Oryctolagus cuniculus small GTP-binding protein | 1034 | 96 |
| 829 | 8110 | AB037823 | Homo sapiens KIAA1402 protein | 4037 | 100 |
| 830 | 8116 | A84493 | unidentified unnamed protein product | 3309 | 100 |
| 831 | 8117 | AB030184 | Mus musculus contains transmembrane (TM) region and ATP binding region | 1586 | 92 |
| 832 | 8123 | AL023694 | Homo sapiens dJ511E16.2 (putative protein based on ESTs) | 663 | 100 |
| 833 | 8130 | AK001138 | Homo sapiens unnamed protein product | 2182 | 99 |
| 834 | 8130 | AK001138 | Homo sapiens unnamed protein product | 1858 | 99 |
| 835 | 8143 | AL022157 | Homo sapiens SPIN (SPINDLIN HOMOLOG (PROTEIN DXF34)) | 1233 | 100 |
| 836 | 8143 | AL022157 | Homo sapiens SPIN (SPINDLIN HOMOLOG (PROTEIN DXF34)) | 1233 | 100 |
| 837 | 8154 | AK001914 | Homo sapiens unnamed protein product | 2176 | 99 |
| 838 | 8155 | AL020996 | Homo sapiens dJ317E23.2 (novel protein with remote similarity to KIAA0009) | 1492 | 100 |
| 839 | 8162 | Z69637 | Caenorhabditis elegans predicted using Genefinder-Similarity to E. coli hypothetical protein YCAC (SW:YCAC_ECOLI)~cDNA EST yk555d12.3 comes from this gene | 240 | 57 |
| 840 | 8163 | AB023167 | Homo sapiens KIAA0950 protein | 1664 | 100 |
| 841 | 8172 | AE003527 | Drosophila melanogaster CG4729 gene product | 737 | 40 |
| 842 | 8173 | AK001350 | Homo sapiens unnamed protein product | 1730 | 99 |
| 843 | 8179 | AF131852 | Homo sapiens Unknown | 473 | 100 |
| 844 | 8182 | AF186593 | Homo sapiens butyrophilin-like | 406 | 27 |
| 845 | 8183 | AC008015 | Homo sapiens unknown | 815 | 96 |
| 846 | 8184 | AE003499 | Drosophila melanogaster CG7860 gene product | 558 | 42 |
| 847 | 8185 | AK001441 | Homo sapiens unnamed protein product | 378 | 46 |
| 848 | 8187 | AJ272267 | Homo sapiens choline dehydrogenase | 2449 | 100 |
| 849 | 8188 | AB001773 | Ciona savignyi PEM-6 | 196 | 34 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 850 | 8190 | AC004955 | Homo sapiens supported by ESTs T61992 (NID:g665235) and W26450 (NID:g1307167) and Genscan | 1618 | 85 |
| 851 | 8190 | AC004955 | Homo sapiens supported by ESTs T61992 (NID:g665235) and W26450 (NID:g1307167) and Genscan | 1618 | 85 |
| 852 | 8192 | AF113534 | Homo sapiens HP1-BP74 protein | 2723 | 96 |
| 853 | 8193 | AF232226 | Danio rerio Dedd1 | 191 | 42 |
| 854 | 8197 | AF132732 | Homo sapiens unknown | 1116 | 70 |
| 855 | 8197 | AF132732 | Homo sapiens unknown | 1010 | 74 |
| 856 | 8199 | AB040905 | Homo sapiens KIAA1472 protein | 3062 | 99 |
| 857 | 8202 | AB018268 | Homo sapiens KIAA0725 protein | 3013 | 100 |
| 858 | 8203 | AE003800 | Drosophila melanogaster CG5742 gene product | 648 | 53 |
| 859 | 8208 | AL117442 | Homo sapiens hypothetical protein | 1344 | 100 |
| 860 | 8209 | AF040964 | Homo sapiens unknown protein IT1 | 3033 | 100 |
| 861 | 8211 | AB020713 | Homo sapiens KIAA0906 protein | 4668 | 99 |
| 862 | 8214 | AJ245417 | Homo sapiens G5b protein | 794 | 100 |
| 863 | 8217 | AB037859 | Homo sapiens KIAA1438 protein | 4761 | 99 |
| 864 | 8223 | AE003469 | Drosophila melanogaster CG13886 gene product | 352 | 45 |
| 865 | 8224 | X58769 | Homo sapiens V alpha gene segment | 284 | 83 |
| 866 | 8226 | AC012680 | Arabidopsis thaliana putative protein phosphatase 2C | 209 | 38 |
| 867 | 8227 | AF132174 | Drosophila melanogaster unknown | 563 | 54 |
| 868 | 8229 | AK000576 | Homo sapiens unnamed protein product | 1342 | 100 |
| 869 | 8232 | AE003638 | Drosophila melanogaster CG5142 gene product | 1420 | 47 |
| 870 | 8236 | Y11710 | Homo sapiens collagen type XIV | 1048 | 97 |
| 871 | 8239 | X82240 | Homo sapiens T cell leukemia/lymphoma 1 | 617 | 100 |
| 872 | 8244 | U42841 | Caenorhabditis elegans short region of weak similarity to collagen | 161 | 34 |
| 873 | 8245 | AF023130 | Homo sapiens Ras-GRF2 | 6413 | 100 |
| 874 | 8248 | AJ131613 | Homo sapiens dicarboxylate carrier protein | 1470 | 99 |
| 875 | 8251 | L27645 | Danio rerio growth-associated protein | 130 | 37 |
| 876 | 8253 | AF141377 | Mus musculus Ly-6/neurotoxin homolog | 527 | 81 |
| 877 | 8260 | AF217544 | Xenopus laevis ornithine decarboxylase-2 | 1451 | 59 |
| 878 | 8262 | AF136631 | Homo sapiens neuritin | 182 | 33 |
| 879 | 8268 | X67098 | Homo sapiens ORF1 | 493 | 100 |
| 880 | 8270 | AB033064 | Homo sapiens KIAA1238 protein | 1480 | 100 |
| 881 | 8272 | AF154831 | Rattus norvegicus PV-1 | 1403 | 60 |
| 882 | 8274 | AF026528 | Rattus norvegicus stathmin-like-protein RB3 | 915 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 883 | 8274 | AF026530 | *Rattus norvegicus* stathmin-like-protein splice variant RB3" | 1093 | 97 |
| 884 | 8275 | U35244 | *Rattus norvegicus* vacuolar protein sorting homolog r-vps33a | 2981 | 96 |
| 885 | 8277 | AL353814 | *Arabidopsis thaliana* putative protein | 425 | 30 |
| 886 | 8281 | AF157318 | *Homo sapiens* AD-017 protein | 912 | 47 |
| 887 | 8283 | AK000461 | *Homo sapiens* unnamed protein product | 1594 | 100 |
| 888 | 8289 | AE003681 | *Drosophila melanogaster* CG11986 gene product | 518 | 38 |
| 889 | 829S | AL031775 | *Homo sapiens* dJ30M3.3 (novel protein similar to *C. elegans* Y63D3A.4) | 1902 | 100 |
| 890 | 8300 | M21103 | *Ovis aries* BIIIB4 high-sulfur keratin | 484 | 82 |
| 891 | 8303 | Z85986 | *Homo sapiens* dJ108K11.3 (similar to yeast suppressor protein SRP40) | 1143 | 75 |
| 892 | 8304 | U18762 | *Rattus norvegicus* retinol dehydrogenase type I | 890 | 52 |
| 893 | 8305 | AF072467 | *Homo sapiens* unknown | 2495 | 100 |
| 894 | 8309 | AB037779 | *Homo sapiens* KIAA1358 protein | 2271 | 100 |
| 895 | 8318 | AE003491 | *Drosophila melanogaster* CG2453 gene product | 527 | 59 |
| 896 | 8319 | AF136631 | *Homo sapiens* neuritin | 742 | 100 |
| 897 | 8321 | AF207989 | *Homo sapiens* orphan G-protein coupled receptor | 2326 | 100 |
| 898 | 8322 | Z97630 | *Homo sapiens* dJ466N1.4 (novel protein similar to ANK3 (ankyrin 3, node of Ranvier (ankyrin G))) | 181 | 44 |
| 899 | 8323 | U21549 | *Mus musculus* Ac39/physophilin | 1280 | 68 |
| 900 | 8325 | AF036694 | *Caenorhabditis elegans* CD4.4 gene product | 189 | 25 |
| 901 | 8331 | AF117814 | *Mus musculus* odd-skipped related 1 protein | 945 | 68 |
| 902 | 8332 | AE003442 | *Drosophila melanogaster* CG2256 gene product | 360 | 50 |
| 903 | 8333 | AK002084 | *Homo sapiens* unnamed protein product | 2469 | 100 |
| 904 | 8335 | AL008729 | *Homo sapiens* predicted protein dJ257A7.2 | 737 | 100 |
| 905 | 8336 | AB032986 | *Homo sapiens* KIAA1160 protein | 1458 | 100 |
| 906 | 8337 | AK000523 | *Homo sapiens* unnamed protein product | 1563 | 99 |
| 907 | 8340 | AE003658 | *Drosophila melanogaster* CG7200 gene product | 436 | 47 |
| 908 | 8343 | AK001344 | *Homo sapiens* unnamed protein product | 1436 | 99 |
| 909 | 8347 | AK002182 | *Homo sapiens* unnamed protein product | 1810 | 99 |
| 910 | 8349 | AK001715 | *Homo sapiens* unnamed protein product | 715 | 99 |
| 911 | 8351 | AF155100 | *Homo sapiens* zinc finger protein NY-REN-21 antigen | 2261 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 912 | 8353 | J05071 | Bos taurus GTP-binding regulatory protein gamma-6 subunit | 356 | 100 |
| 913 | 8355 | AK001046 | Homo sapiens unnamed protein product | 1173 | 99 |
| 914 | 8361 | AL050170 | Homo sapiens hypothetical protein | 714 | 100 |
| 915 | 8365 | X64002 | Homo sapiens RAP74 | 2661 | 99 |
| 916 | 8367 | X04085 | Homo sapiens catalase | 2846 | 100 |
| 917 | 8369 | AJ278124 | Homo sapiens hypothetical protein | 1570 | 100 |
| 918 | 8370 | Z48745 | Mus musculus ABC8 | 1101 | 69 |
| 919 | 8375 | AF045564 | Rattus norvegicus development-related protein | 1715 | 93 |
| 920 | 8387 | X97571 | Mus musculus HCMV-interacting protein | 479 | 96 |
| 921 | 8391 | L08239 | Homo sapiens located at OATL1 | 2274 | 100 |
| 922 | 8393 | AF121863 | Homo sapiens sorting nexin 14 | 1964 | 100 |
| 923 | 8393 | AF121863 | Homo sapiens sorting nexin 14 | 1203 | 84 |
| 924 | 8394 | AL050101 | Homo sapiens hypothetical protein | 2848 | 100 |
| 925 | 8395 | AE003681 | Drosophila melanogaster CG11990 gene product | 1517 | 59 |
| 926 | 8396 | Y18101 | Mus musculus macrophage actin-associated-tyrosine-phosphorylated protein | 1559 | 87 |
| 927 | 8398 | AL050318 | Homo sapiens dJ977B1.4 (novel protein similar to TGIF (TG-interacting factor (TALE family homeobox))) | 1224 | 100 |
| 928 | 8402 | AB026264 | Homo sapiens IMPACT | 1694 | 100 |
| 929 | 8402 | AB026264 | Homo sapiens IMPACT | 1123 | 100 |
| 930 | 8405 | Z82062 | Caenorhabditis elegans cDNA EST yk415c12.5 comes from this gene~cDNA EST yk526h3.3 comes from this gene~cDNA EST yk599b1.3 comes from this gene | 431 | 42 |
| 931 | 8406 | AK001692 | Homo sapiens unnamed protein product | 2492 | 99 |
| 932 | 8409 | AL035602 | Arabidopsis thaliana putative protein | 499 | 28 |
| 933 | 8410 | AL050107 | Homo sapiens hypothetical protein | 1342 | 100 |
| 934 | 8414 | AK000508 | Homo sapiens unnamed protein product | 503 | 100 |
| 935 | 8415 | AL021453 | Homo sapiens dJ821D11.3 (PUTATIVE protein) | 856 | 100 |
| 936 | 8419 | AJ276003 | Homo sapiens GAR1 protein | 1216 | 100 |
| 937 | 8426 | D26185 | Bacillus subtilis unknown | 365 | 33 |
| 938 | 8430 | AC004874 | Homo sapiens similar to N-acetylgalactosaminyl transferase; similar to Q07537 (PID:g1171989) | 957 | 100 |
| 939 | 8431 | AF199597 | Homo sapiens A-type potassium channel modulatory protein 1 | 1139 | 100 |
| 940 | 8432 | Y13148 | Rattus norvegicus PAG608 | 1350 | 88 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 941 | 8433 | M24852 | *Rattus norvegicus* neuron-specific protein PEP-19 | 124 | 46 |
| 942 | 8434 | AF146738 | *Rattus norvegicus* testis specific protein | 771 | 83 |
| 943 | 8438 | AK000427 | *Homo sapiens* unnamed protein product | 358 | 36 |
| 944 | 8439 | AB017644 | *Homo sapiens* ubiquitin-conjugating enzyme E2 | 919 | 85 |
| 945 | 8441 | AC006538 | *Homo sapiens* BC41195_1 | 831 | 78 |
| 946 | 8450 | AB004316 | *Bos taurus* mitochondrial methionyl-tRNA transformylase | 1556 | 88 |
| 947 | 8451 | Z35094 | *Homo sapiens* SURF-2 | 1354 | 97 |
| 948 | 8452 | AL050275 | *Homo sapiens* hypothetical protein | 2351 | 99 |
| 949 | 8460 | AC006014 | *Homo sapiens* similar to RFP transforming protein; similar to P14373 (PID:g132517) | 1299 | 100 |
| 950 | 8461 | AC005099 | *Homo sapiens* match to AI222572 (NID:g3804775) | 469 | 100 |
| 951 | 8462 | V00507 | *Homo sapiens* coding sequence of DHFR (1 is 1st base in codon) (561 is 3rd base in codon) | 984 | 100 |
| 952 | 8464 | AL049709 | *Homo sapiens* dJ18C9.2 (novel gene (locus D20S101) similar to Gamma-glutamyltranspeptidase, contains CCA trinucleotide repeat, based on Genscan and Fgenesh predictions.) | 3370 | 99 |
| 953 | 8465 | AF173871 | *Mus musculus* neuronal PAS3 | 977 | 94 |
| 954 | 8467 | AF178983 | *Homo sapiens* Ras-associated protein Rap1 | 433 | 97 |
| 955 | 8470 | AB037858 | *Homo sapiens* KIAA1437 protein | 1724 | 58 |
| 956 | 8471 | AF109674 | *Rattus norvegicus* late gestation lung protein 1 | 846 | 74 |
| 957 | 8473 | AF061346 | *Mus musculus* Edp1 protein | 1077 | 64 |
| 958 | 8474 | AK000343 | *Homo sapiens* unnamed protein product | 1272 | 100 |
| 959 | 8475 | AF233582 | *Mus musculus* GTPase Rab37 | 942 | 95 |
| 960 | 8476 | AF195951 | *Homo sapiens* signal recognition particle 68 | 3127 | 98 |
| 961 | 8480 | AL080168 | *Homo sapiens* hypothetical protein | 2128 | 100 |
| 962 | 8482 | AE003713 | *Drosophila melanogaster* CG14898 gene product | 207 | 44 |
| 963 | 8482 | AE003713 | *Drosophila melanogaster* CG14898 gene product | 91 | 60 |
| 964 | 8486 | Z81592 | *Caenorhabditis elegans* predicted using Genefinder | 426 | 55 |
| 965 | 8488 | AK000559 | *Homo sapiens* unnamed protein product | 1319 | 99 |
| 966 | 8492 | Z71181 | *Caenorhabditis elegans* similar to hydrolase | 601 | 38 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 967 | 8494 | Z81105 | Caenorhabditis elegans similar to alpha/beta hydrolase fold~cDNA EST EMBL:T02320 comes from this gene | 460 | 40 |
| 968 | 8496 | S94421 | Homo sapiens T cell receptor eta-exon | 478 | 100 |
| 969 | 8497 | AL050214 | Homo sapiens hypothetical protein | 949 | 99 |
| 970 | 8499 | AF161380 | Homo sapiens HSPC262 | 772 | 100 |
| 971 | 8513 | AE003802 | Drosophila melanogaster CG14480 gene product | 423 | 44 |
| 972 | 8522 | AK001972 | Homo sapiens unnamed protein product | 520 | 38 |
| 973 | 8526 | U41012 | Caenorhabditis elegans C06A6.3 gene product | 172 | 24 |
| 974 | 8531 | AE003635 | Drosophila melanogaster CG5336 gene product | 1064 | 50 |
| 975 | 8533 | AJ001019 | Homo sapiens ring finger protein | 1301 | 100 |
| 976 | 8542 | AF003388 | Caenorhabditis elegans R10F2.5 gene product | 346 | 37 |
| 977 | 8544 | AF178632 | Homo sapiens FEM-1-like death receptor binding protein | 3261 | 100 |
| 978 | 8565 | AC006033 | Homo sapiens similar to MLN 64; similar to I38027 (PID:g2135214) | 1195 | 100 |
| 979 | 8565 | AC006033 | Homo sapiens similar to MLN 64; similar to I38027 (PID:g2135214) | 668 | 93 |
| 980 | 8572 | AB023811 | Homo sapiens TU3A | 351 | 55 |
| 981 | 8576 | AE003802 | Drosophila melanogaster CG4996 gene product | 362 | 37 |
| 982 | 8578 | AF065441 | Mus musculus FGF binding protein 1 | 174 | 24 |
| 983 | 8584 | AK000367 | Homo sapiens unnamed protein product | 3440 | 98 |
| 984 | 8598 | D87463 | Homo sapiens KIAA0273 | 1396 | 76 |
| 985 | 8602 | AL117600 | Homo sapiens hypothetical protein | 2786 | 99 |
| 986 | 8604 | AJ249735 | Homo sapiens claudin-6 | 1142 | 100 |
| 987 | 8609 | X57560 | Escherichia coli pspE protein | 535 | 100 |
| 988 | 8612 | AF169284 | Homo sapiens LIM and cysteine-rich domains protein 1 | 1997 | 100 |
| 989 | 8637 | AE003559 | Drosophila melanogaster CG8576 gene product | 592 | 46 |
| 990 | 8640 | AB024523 | Homo sapiens basic kruppel like factor | 1206 | 100 |
| 991 | 8643 | X55989 | Homo sapiens eosinophil cationic-related protein | 737 | 99 |
| 992 | 8645 | AF007151 | Homo sapiens unknown | 1481 | 100 |
| 993 | 8650 | X52904 | Escherichia coli open reading frame (AA 1–65) | 359 | 100 |
| 994 | 8651 | U19577 | Escherichia coli galactonate dehydratase | 242 | 93 |
| 995 | 8654 | AL117660 | Homo sapiens hypothetical protein | 447 | 100 |
| 996 | 8655 | AK001355 | Homo sapiens unnamed protein product | 1553 | 100 |
| 997 | 8657 | AE003693 | Drosophila melanogaster CG18347 gene product | 686 | 54 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 998 | 8665 | AF044774 | Homo sapiens breakpoint cluster region protein 2 | 2681 | 99 |
| 999 | 8668 | AL008729 | Homo sapiens predicted protein dJ257A7.1 | 416 | 100 |
| 1000 | 8671 | X82693 | Homo sapiens E48 antigen | 620 | 96 |
| 1001 | 8672 | AE003499 | Drosophila melanogaster CG7872 gene product | 692 | 51 |
| 1002 | 8692 | AF131218 | Homo sapiens chromosome 16 open reading frame 5 | 1493 | 100 |
| 1003 | 8706 | AL021396 | Homo sapiens dJ971N18.2 | 1375 | 100 |
| 1004 | 8716 | AF196972 | Homo sapiens JM24 protein | 2239 | 100 |
| 1005 | 8719 | AF053356 | Homo sapiens insulin receptor substrate like protein | 228 | 97 |
| 1006 | 8743 | AL050214 | Homo sapiens hypothetical protein | 949 | 99 |
| 1007 | 8764 | AF153127 | Gallus gallus SAPK interacting protein | 2442 | 89 |
| 1008 | 8764 | AF153127 | Gallus gallus SAPK interacting protein | 1477 | 83 |
| 1009 | 8764 | AF153127 | Gallus gallus SAPK interacting protein | 1651 | 86 |
| 1010 | 8774 | X56932 | Homo sapiens 23 kD highly basic protein | 1044 | 100 |
| 1011 | 8782 | AF174605 | Homo sapiens F-box protein Fbx25 | 467 | 70 |
| 1012 | 8796 | AB033097 | Homo sapiens KIAA1271 protein | 2824 | 100 |
| 1013 | 8827 | Y17013 | porcine endogenous retrovirus pol | 304 | 64 |
| 1014 | 8842 | AE003416 | Unknown Symbol = BG:DS01068.6; cDNA = method: "sim4", score: "1000.0", desc: "LD09509 LD Drosophila | 1550 | 48 |
| 1015 | 8842 | AE003416 | Unknown symbol = BG:DS01068.6; cDNA = method: "sim4", score: "1000.0", desc: "LD09509 LD Drosophila | 1207 | 45 |
| 1016 | 8858 | AL133215 | Homo sapiens bA108L7.2 (novel protein similar to rat tricarboxylate carrier) | 1322 | 99 |
| 1017 | 8871 | AK001721 | Homo sapiens unnamed protein product | 1707 | 99 |
| 1018 | 8921 | U29495 | Mus musculus Zfp61p | 299 | 52 |
| 1019 | 8927 | AK001344 | Homo sapiens unnamed protein product | 1086 | 100 |
| 1020 | 8942 | AF146568 | Homo sapiens MIL1 protein | 1936 | 100 |
| 1021 | 8994 | AE003802 | Drosophila melanogaster CG6410 gene product | 349 | 42 |
| 1022 | 9023 | U10362 | Homo sapiens GP36b glycoprotein | 1001 | 55 |
| 1023 | 9028 | AB018341 | Homo sapiens KIAA0798 protein | 307 | 70 |
| 1024 | 9058 | AE003442 | Drosophila melanogaster CG10778 gene product | 636 | 54 |
| 1025 | 9058 | AE003442 | Drosophila melanogaster CG10778 gene product | 429 | 53 |
| 1026 | 9079 | AB027004 | Homo sapiens protein phosphatase | 1018 | 100 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 1027 | 9079 | AB027003 | *Mus musculus* protein phosphatase | 378 | 84 |
| 1028 | 9082 | U64856 | *Caenorhabditis elegans* weak similarity to TPR domains | 215 | 40 |
| 1029 | 9084 | AL110241 | *Homo sapiens* hypothetical protein | 1240 | 97 |
| 1030 | 9093 | X76717 | *Homo sapiens* MT-11 protein | 204 | 89 |
| 1031 | 9101 | AK00181B | *Homo sapiens* unnamed protein product | 910 | 100 |
| 1032 | 9103 | AK001182 | *Homo sapiens* unnamed protein product | 1752 | 94 |
| 1033 | 9105 | AF187016 | *Homo sapiens* myosin regulatory light chain interacting protein MIR | 2303 | 99 |
| 1034 | 9151 | AB037730 | *Homo sapiens* KIAA1309 protein | 894 | 35 |
| 1035 | 9161 | AK001659 | *Homo sapiens* unnamed protein product | 1886 | 99 |
| 1036 | 9172 | *Plasmodium falciparum* | 3' end., gene product | 178 | 23 |
| 1037 | 9174 | AK001324 | *Homo sapiens* unnamed protein product | 2657 | 99 |
| 1038 | 9204 | AF161548 | *Homo sapiens* HSPC063 | 1018 | 98 |
| 1039 | 9234 | AB041581 | *Mus musculus* unnamed protein product | 1758 | 95 |
| 1040 | 9235 | X98507 | *Homo sapiens* myosin I beta | 5288 | 99 |
| 1041 | 9239 | AL133107 | *Homo sapiens* hypothetical protein | 1388 | 100 |
| 1042 | 9256 | D90869 | *Escherichia coli* similar to | 2047 | 100 |
| 1043 | 9276 | A12029 | *Homo sapiens* MRP-14 | 613 | 100 |
| 1044 | 9345 | AC005328 | *Homo sapiens* R26660_1, partial CDS | 870 | 74 |
| 1045 | 9379 | AC024876 | *Caenorhabditis elegans* contains similarity to SW:RPB1_CRIGR | 829 | 61 |
| 1046 | 9435 | AB014536 | *Homo sapiens* KIAA0636 protein | 1876 | 64 |
| 1047 | 9437 | U85055 | *Mus musculus* rap1/rap2 interacting protein | 2103 | 90 |
| 1048 | 9469 | AP000060 | Aeropyrum pernix 264aa long hypothetical protein | 108 | 33 |
| 1049 | 9500 | AE003638 | *Drosophila melanogaster* CG12404 gene product | 583 | 48 |
| 1050 | 9502 | X78927 | *Homo sapiens* zinc finger protein | 3865 | 99 |
| 1051 | 9520 | AL163279 | *Homo sapiens* homolog to cAMP response element binding and beta transducin family proteins | 5035 | 99 |
| 1052 | 9541 | Z48475 | *Homo sapiens* glucokinase regulator | 3160 | 99 |
| 1053 | 9541 | Z48475 | *Homo sapiens* glucokinase regulator | 2682 | 97 |
| 1054 | 9548 | AF195764 | *Homo sapiens* megakaryocyte - enhanced gene transcript 1 protein; MEGT1 protein | 2055 | 99 |
| 1055 | 9556 | AC004382 | *Homo sapiens* Unknown gene product | 1593 | 100 |
| 1056 | 9556 | AC004382 | *Homo sapiens* Unknown gene product | 984 | 100 |
| 1057 | 9575 | AL117352 | *Homo sapiens* dJ876B10.3 (novel protein similar to *C. elegans* T19B10.6 (Tr:Q22557)) | 2581 | 99 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
| --- | --- | --- | --- | --- | --- |
| 1058 | 9589 | AE003454 | *Drosophila melanogaster* CG10440 gene product | 218 | 43 |
| 1059 | 9599 | AJ245621 | *Homo sapiens* CTL2 protein | 3728 | 99 |
| 1060 | 9602 | AE003673 | *Drosophila melanogaster* CG1939 gene product | 440 | 40 |
| 1061 | 9606 | X05562 | *Homo sapiens* alpha-2 chain precursor (AA - 25 to 1018) (3416 is 2nd base in codon) | 5908 | 99 |
| 1062 | 9622 | Z98048 | *Homo sapiens* dJ408N23.4 (novel DnaJ domain protein) | 1296 | 99 |
| 1063 | 9623 | AF154415 | *Homo sapiens* FLASH | 10253 | 100 |
| 1064 | 9646 | U20286 | *Rattus norvegicus* lamina associated polypeptide 1C | 1567 | 70 |
| 1065 | 9747 | AB033101 | *Homo sapiens* KIAA1275 protein | 5625 | 99 |
| 1066 | 9773 | AL117337 | *Homo sapiens* bA393J16.1 (zinc finger protein 33a (KOX 31)) | 250 | 60 |
| 1067 | 9785 | AC005328 | *Homo sapiens* R26660_1, partial CDS | 1126 | 100 |
| 1068 | 9801 | AB033092 | *Homo sapiens* KIAA1266 protein | 3067 | 99 |
| 1069 | 9811 | AE003633 | *Drosophila melanogaster* CG14939 gene product | 961 | 76 |
| 1070 | 9843 | AL080080 | *Homo sapiens* hypothetical protein | 1508 | 100 |
| 1071 | 9854 | AB037360 | *Homo sapiens* ANKHZN | 5734 | 95 |
| 1072 | 9854 | AB037360 | *Homo sapiens* ANKHZN | 959 | 97 |
| 1073 | 9864 | AF237676 | *Mus musculus* G beta-like protein GBL | 1721 | 96 |
| 1074 | 9864 | AF237676 | *Mus musculus* G beta-like protein GBL | 1043 | 70 |
| 1075 | 9871 | U26358 | *Rattus norvegicus* S100A1 gene product | 137 | 36 |
| 1076 | 9879 | AF212162 | *Homo sapiens* ninein | 10369 | 99 |
| 1077 | 9881 | AK000463 | *Homo sapiens* unnamed protein product | 1252 | 99 |
| 1078 | 98B5 | AC004890 | *Homo sapiens* similar to zinc finger proteins; similar to BAA24380 | 542 | 86 |
| 1079 | 9901 | AF187989 | *Homo sapiens* zinc finger protein ZNF223 | 2665 | 99 |
| 1080 | 9912 | AC035150 | *Homo sapiens* Zinc finger protein ZNF221 | 3459 | 100 |
| 1081 | 9916 | Z82095 | *Caenorhabditis elegans* similar to PDZ domain (Also known as DHR or GLGF). ~cDNA EST EMBL:M75803 comes from this gene | 702 | 54 |
| 1082 | 9921 | AF117610 | *Mus musculus* inner centromere protein INCENP | 583 | 58 |
| 1083 | 9925 | X90840 | *Homo sapiens* axonal transporter of synaptic vesicles | 4584 | 99 |
| 1084 | 9930 | AF148848 | *Homo sapiens* myoneurin | 3208 | 99 |
| 1085 | 9949 | AB033037 | *Homo sapiens* KIAA1211 protein | 3939 | 98 |
| 1086 | 9951 | AK001605 | *Homo sapiens* unnamed protein product | 647 | 96 |
| 1087 | 9959 | AF140342 | *Homo sapiens* autoantigen SS-N | 37 | 36 |
| 1088 | 9973 | AK001753 | *Homo sapiens* unnamed protein product | 193 | 82 |

TABLE 2-continued

| SEQ ID NO | CORRESPONDING SEQ ID NO. IN U.S. Ser. No. 09/552,317 | ACCESSION NUMBER | DESCRIPTION | SMITH-WATERMAN SCORE | % IDENTITY |
|---|---|---|---|---|---|
| 1089 | 9982 | AL133396 | Homo sapiens dJ1068H6.4 (prion protein like protein doppel) | 962 | 100 |
| 1090 | 9994 | AK001192 | Homo sapiens unnamed protein product | 2550 | 100 |
| 1091 | 10021 | AK001842 | Homo sapiens unnamed protein product | 546 | 100 |
| 1092 | 10041 | Z54096 | Schizosaccharomyces pombe hypothetical coiled-coil protein | 320 | 40 |
| 1093 | 10045 | AK001122 | Homo sapiens unnamed protein product | 227 | 43 |
| 1094 | 10067 | Y12090 | Lycopersicon esculentum putative 3,4-dihydroxy-2-butanone kinase | 1040 | 42 |
| 1095 | 10073 | X81058 | Mus musculus tex261 | 1010 | 99 |
| 1096 | 10112 | AB012084 | Mus musculus ITM | 194 | 30 |
| 1097 | 10117 | AB030251 | Homo sapiens GTPase activating protein ID-GAP | 3233 | 99 |
| 1098 | 10132 | AJ01058S | Rattus rattus PTB-like protein | 2684 | 99 |
| 1099 | 10169 | X75760 | Drosophila melanogaster LRR47 | 364 | 30 |
| 1100 | 10217 | U76618 | Mus musculus N-RAP | 804 | 48 |
| 1101 | 10226 | AC005578 | Homo sapiens F20887_1, partial CDS | 835 | 65 |
| 1102 | 10232 | D90832 | Escherichia coli ORF_ID:o341#12; similar to | 360 | 100 |
| 1103 | 10237 | X01563 | Escherichia coli L5 (rp1E)(aa 1–179) | 911 | 100 |
| 1104 | 10279 | AL133206 | Homo sapiens hypothetical protein | 1820 | 99 |

SEQUENCE LISTING (1105 sequences)

SEQ ID NO: 1 - DNA, 2063 bp, Homo sapiens
  CDS (1)..(1677)
atgaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacgaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtgctgccccggcctccacccacctgtgcaggcctcctggggccctgcctccacccctcccagatggacagccagactaggtgggggcaggtgagggtggaaaagaggtcagggctctactgttgggctttagcctctggtggtgcctcccgaggatttgctcctggctcttcccaagggctttgcagctggatcactctggactggctccctggggacctcctgaacctgttggttgcagggacggggagcatctaccaaggttcattctagagggaggtaaggccccatgattcctagggaggagccctgagccccactccccgccccaagtctgggtgacagagcagtgacttggaggaatgtggcctcatccttccttggggacctgttgagaattcccacctgtttagaggcagatggttttgatctccctaaatgaaatggttttagctcaaaaaaaaaa

SEQ ID NO: 2 - DNA, 1352 bp, Homo sapiens
  CDS (209)..(673)
acaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctcccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcaaaaaaaaaaaaaaa

SEQ ID NO: 3 - DNA, 5143 bp, Homo sapiens
  CDS (501)..(4277)
tgtgtcttgagactcgatatacctatctattcgatgatgaagataccccaccagacccaaaaaaagagatctctcgaggatccgaattcgcggccgcgtcgaccgcgcccctgccgcggcccctagctcgggcctcaggggcctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcagaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaaaaaaaaaaaa

SEQ ID NO: 4 - DNA, 3274 bp, Homo sapiens
  CDS (65)..(1303)
cacgaggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgaccccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctccgggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtcttcattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaaaaaaaaaa

SEQ ID NO: 5 - DNA, 1941 bp, Homo sapiens
  CDS (138)..(773)
gcacgaggagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagcctggcggtcccggcgaacgacggcgcatggagaacttccgtaaggtgcgctccgaagaggcgccacggggatgcggggccgagggaggcggcccgggctccggcccgttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaagggactgcccagtccctgggttcttcctctcttctttccccactccgccctcccggctgggcctgggcttcagagggtgtttgcaaatgggggggccctggtaacctttaacattggtcattaaggggaaagggagcgggacattgtttttttggggagggggaaggaagggagttggaaagacaacattcgtggaatctttgggggggtcaatggaaaagggtggaagacccgtttagggtctcgaattttgaggtttcagacaataaatgtaactttaccagaaggttgggaaaaaggcccatttttgggtagggttttccttaatttcttc

SEQ ID NO: 6 - DNA, 1663 bp, Homo sapiens
  CDS (413)..(1420)
tcggtaccggcccggaattcccgggtcgacccacgcgtgcgcccacgcgtccgcgttgtgccagatgcacagcacattgtgtgacactgacttaagattctaactctgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccagctgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctggttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcctcagaacaacgacagcggccgctctagaggatccaagcttacgtacgcgtgcatgcgacgtcatagctcttctatagtgtcacctaaatt

SEQ ID NO: 7 - DNA, 1920 bp, Homo sapiens
  CDS (120)..(1394)
gaccgtcccggaattcccgggtcgacccacgcgtccgggaagataaggcggcgcgggaagaggacacagggtgggctggagctcaaatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggtgcctctcccaccgaagtgacccaaatgcagtggcacctgccccccagggtgtgaggctcagcctatgccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcggggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtcagtctggtcctcccttgcccatcctgtctccctaccccgccatcatctgggattccaagctgttatgcacatcagccctgaattttgtatggaaagatggagagaggaggggagcctggggcaggggaagggggatcccatttcttcccaccctgaggagcttgaattctgctgggtgacaaatgggcttgaggaagaagggcattttaaagcagttattccttctatttctttaggtaaagagatcaggacagcaagcaagacttcagtagcaaacactacagtcaggtacctggactcgcctctacccagcagaccctgactccagcagattctggcccagggacaggaggaagagatgccaccagggctggtctcccaggagtagagaccatgggaaatggggtggattaggattgagctggaggagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgtaaaaaaaaaaaa

SEQ ID NO: 8 - DNA, 1609 bp, Homo sapiens
  CDS (309)..(1202)
ctagttcgagatctcgcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcagtaagtccttgcagagtccatgggtttcttcgacaagtggcttcaaggaagggaattcccacccttgtcttccagcaaggccacacacatgaaaccagcagaaaagagtcttatttgctggaaagacccccagcaagggcatagtgagcccttacagtggttccagtcagaaaaggcaccacttgggtgggcacagccccatgggtgtccaacttggtaagcagagcaaggctggacttgagtccccgtcctccacaaaacacagagccacaagccccagccctgcagcagccctccggaagcagcggggcactggtttccttgtcccctgccatctaccgagtggctcactctcaggtgggagtgctggtggtggttaattaggactgcagaaacatgagtctccttaacaaagtattgggactcttaagggtaagtgtgaaaaaggaatggtctaaatgcattaatcttgaataaaccgaaaaccaaaaaaaaaaaa

SEQ ID NO: 9 - DNA, 3045 bp, Homo sapiens
  CDS (587)..(2683)
  misc_feature (1)...(3045): n = a,t,c or g
cctgcaggtaccggtccggaattcccgggtcgacccacgcgtccgggctcgctgctcacaccccctcctgccagtgcagcgcgagtaagagcgcccaagggaccacagctggcatcccaggggttaatttcggagcagcccaggtggaggtcgagcccccaaccccgtcggcacctccaggcttccgaggccaccggaacggaggaggcttcggtggctctttgtctacctgctctgggtgttaaagagcccgctcgcagcctgcatcgccggggctcgggacagaagtcagcggcggggaaatggggctctgtcactttaagtacagctggagccctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcatagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaaggtaggacatccagccacagattgagagggaacagggagcaggaaagtaagagtattacagatttttatctgggcccatagtattccaagtcctatatcaagtctctagaaggtgagggcctttagataccctttagtgtgatgtctggactggtcagtgaggagtaccaggggcatgaccccagcttcctagggcatgaaggcaagcagaggagacctgtaagccccaggggtcctctccttaacctttacctcacggccaaagagccatcaaagaccatcgttaaaatagccctttacattnttatgcaaatgtgttgtgtgtccacacacacacaaacaatcttatttgatcctcactttagttctccaactactcttccaatganacaaccaaagctcacataggttatatggtgctgaaatggcaagttagccctgag

SEQ ID NO: 10 - DNA, 2874 bp, Homo sapiens
  CDS (587)..(2512)
  misc_feature (1)...(2874): n = a,t,c or g
cctgcaggtaccggtccggaattcccgggtcgacccacgcgtccgggctcgctgctcacaccccctcctgccagtgcagcgcgagtaagagcgcccaagggaccacagctggcatcccaggggttaatttcggagcagcccaggtggaggtcgagcccccaaccccgtcggcacctccaggcttccgaggccaccggaacggaggaggcttcggtggctctttgtctacctgctctgggtgttaaagagcccgctcgcagcctgcatcgccggggctcgggacagaagtcagcggcggggaaatggggctctgtcactttaagtacagctggagccctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcatagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaaggtaggacatccagccacagattgagagggaacagggagcaggaaagtaagagtattacagatttttatctgggcccatagtattccaagtcctatatcaagtctctagaaggtgagggcctttagataccctttagtgtgatgtctggactggtcagtgaggagtaccaggggcatgaccccagcttcctagggcatgaaggcaagcagaggagacctgtaagccccaggggtcctctccttaacctttacctcacggccaaagagccatcaaagaccatcgttaaaatagccctttacattnttatgcaaatgtgttgtgtgtccacacacacacaaacaatcttatttgatcctcactttagttctccaactactcttccaatganacaaccaaagctcacataggttatatggtgctgaaatggcaagttagccctgag

SEQ ID NO: 11 - DNA, 3069 bp, Homo sapiens
  CDS (587)..(2707)
  misc_feature (1)...(3069): n = a,t,c or g
cctgcaggtaccggtccggaattcccgggtcgacccacgcgtccgggctcgctgctcacaccccctcctgccagtgcagcgcgagtaagagcgcccaagggaccacagctggcatcccaggggttaatttcggagcagcccaggtggaggtcgagcccccaaccccgtcggcacctccaggcttccgaggccaccggaacggaggaggcttcggtggctctttgtctacctgctctgggtgttaaagagcccgctcgcagcctgcatcgccggggctcgggacagaagtcagcggcggggaaatggggctctgtcactttaagtacagctggagccctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcatagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaaggtaggacatccagccacagattgagagggaacagggagcaggaaagtaagagtattacagatttttatctgggcccatagtattccaagtcctatatcaagtctctagaaggtgagggcctttagataccctttagtgtgatgtctggactggtcagtgaggagtaccaggggcatgaccccagcttcctagggcatgaaggcaagcagaggagacctgtaagccccaggggtcctctccttaacctttacctcacggccaaagagccatcaaagaccatcgttaaaatagccctttacattnttatgcaaatgtgttgtgtgtccacacacacacaaacaatcttatttgatcctcactttagttctccaactactcttccaatganacaaccaaagctcacataggttatatggtgctgaaatggcaagttagccctgag

SEQ ID NO: 12 - DNA, 2243 bp, Homo sapiens
  CDS (216)..(2129)
  misc_feature (1)...(2243): n = a,t,c or g
aaggccattaacaatgacactcgtccctatttaggtgacactatagaacaagtttgtacaaaaaagcaggctggtaccggtccggaattcctgggatatcgtcgacccacgcgtccgcccacgcgtccgcggacgcgtgggccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagagggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgctgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaaaaaaaaaaaaaaagggcggccgctctagagtatccctcgaggggcccaagcttacgcgtacccagctttcttgtacaaagtggtccctatagtgagtcgtatataagctagggactggtcgagtgtaatcaatnttacaccc

SEQ ID NO: 13 - DNA, 2042 bp, Homo sapiens
  CDS (141)..(1646)
attgtcgcctgtcgattcggcacgaggcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaa

SEQ ID NO: 14 - DNA, 1392 bp, Homo sapiens
  CDS (164)..(520)
caggagggtgtaggaatagaccatgggatctccgcctatttaggtgacactatagaacaagtttgtacaaaaaagcaggctggtaccggtccggaattcccgggatatcgtcgacccacgcgtccggtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtcaaaaaaaaaaaa

SEQ ID NO: 15 - DNA, 2242 bp, Homo sapiens
  CDS (156)..(1649)
ctgcaggtaccgctccggaattcccgggtcgacgatttcgtgcggtggggacgcgctgtgttctcgcagctcagaggcgggtctgaggctcggtggcggcgcccagggtggcccgggccctttcctcggtcgttgtctcaccgccacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggacttgcgtcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaacagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttagaatggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttaaaaaaaaaaaa

SEQ ID NO: 16 - DNA, 753 bp, Homo sapiens
  CDS (258)..(593)
aactgagttgcctatgtatatacctatctattcgatgatgaagataccccaccaaacccaaaaaaagagatctctcgaggatccgaattcgcggccgcgtcgaccggggtttccccatgttggccaggatggtctcgctctcctgaccttgtaatccgcctgcctcggtctcccaaggtgctggaattacaggcttgagccaccatgcccccaagtgttttcatccagtgatcaggactgaacacagaggactcaccatggagtttgggctgagctggcttttccttgctgctttttttaaaggtgttcagtgcgaggtgcagctggtggagtctggggggggcttggttaaggcgggggggtccctaagactctcctgtgcagcgtctggattcaggtccacttctgcctcgatgagctgggtccgccaacgtccagggaaggggctggagtggcttggccatattaaaagtaaagatgacgatgggacgacagactacgctgcacccgtgaaaggcagattcaccatctcaagagatgattcggaaaacacgggtcgacgcggccgcgaattccagatctatgaatcgtagatactgaaaaaccccgcaagttcacttcaactgtgcatcgtgcaccatctcaatttctttcatttatacatcgttttgccttcttttatgtaactatactcctctaagtttcaatcttggccatgtaacctctgatctatagaattttttaaatgactag

SEQ ID NO: 17 - DNA, 2097 bp, Homo sapiens
  CDS (141)..(1757)
atttggccctcgaggccaagaattcggcacgagcacacacctgggcaggaggctgcccctcctccctggtttgaggaagcaggaaaaggtacccgcgagagacagccagcaattctttggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgatgtcactctcctcgctgaagccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacactgaccatggacatccaaccaagggggcccttccccaccagcagggaccctcttctttctgtccctccgactacaaccaacagcagccgagggacgaacagcactttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtgaaaaaaaaaaaa

SEQ ID NO: 18 - DNA, 2743 bp, Homo sapiens
  CDS (719)..(1909)
aagctcgtacgcctgcaggtaccggtccggaattcccgggtcgactactactactaaattcgcggccgcgtcgaccgtgctttcccattttgctcagcgactgtttgatgacgtcccgcaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctcccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccgctctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaacaaaaaggaaggagcccaaagtgattagaaagaaatgaaatctctttttgggttctgtctactgaaatttaatatctcagtgaacagactaaaaggaatttagaatcctaacaacttaccagatttctcctgttttaaatatactgggactttaaaggttatatgtccggtcaccgtatgttttaagtcggtgttaatgctaacagtgttgaaaacaatatttcatgagatctaattgtggttgcccctataggtagcaggaaagtaaagttgcatttccctctcgcacattctacacccaagtgcctaaaagatctcattgtaagtgggtagtgttaccggaagccattgtgttcacacgggggaaatgccgtatatatttttcaacaaatattaacgtttatactttcatgtttgaaaatttaattaaaaatatttgttttaaaaaaaaaaaaaa

SEQ ID NO: 19 - DNA, 2747 bp, Homo sapiens
  CDS (206)..(1618)
gtgccctgccgtaccggtccggaattcccgggtcgacgatttcgtgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccatccactgatgggatagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgag

SEQ ID NO: 20 - DNA, 2840 bp, Homo sapiens
  CDS (206)..(1711)
gtgccctgccgtaccggtccggaattcccgggtcgacgatttcgtgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccatccactgatgggatagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgag

SEQ ID NO: 21 - DNA, 1367 bp, Homo sapiens
  CDS (355)..(1278)
tacgcacgctgtaccggtccggaattcccgggtcgacccacgcgtccgcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggctgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggatggagcgagagggctccttccacagcaatgacctcttcttggatgcccagctgctccaaagaactggagttggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcaaaaaaaaaaaaaaa

SEQ ID NO: 22 - DNA, 2615 bp, Homo sapiens
  CDS (160)..(849)
ccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattaaaaaaaaaaaa

SEQ ID NO: 23 - DNA, 1463 bp, Homo sapiens
  CDS (178)..(1002)
aagtacacaccctccagcacgactcgggacaggcacgtgcgcccctattacctgctggagtccctcaggacacctggctggagctgatgggcatgggcgggtgtgtgcgagcatgagcccgcaggtctgtgagcttcgtctccctttccttcttcgcagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtaaaaaaaaaaaaaa

SEQ ID NO: 24 - DNA, 2288 bp, Homo sapiens
  CDS (832)..(1752)
gaggtaccggtccggaattcccgggtcgacccacgcgtccggatgaaaatccccttgggaccctgagagtgaggggaaggtcacggaagccgagagatccaggaatgtgaggtcagaggctgacctggttgtccacgcggatgttcgaaactcccaggatggagagaaaaacagagcaggaggaatgaggaagatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaagcaaattgatgttcacgtctgacgtgggcgcgggctgcgcagggcggcgccagaccccaaccgcctcccaggggctagactgagcccggcccaaggggtgtgaaatagaatttattgtggctctgattatgtacacgtgaaatggcctggctgggccggccgggctcacatggtttgtacaataaatacatctgtggggcgggctctccccagccgggaagggccccccccccggttcagtccaaaaaaaaaaaaaaaa

SEQ ID NO: 25 - DNA, 6435 bp, Homo sapiens
  CDS (192)..(5339)
atgtaccgctccggaattcccgggtcgacgatttcgtagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaaaaaaaa

SEQ ID NO: 26 - DNA, 932 bp, Homo sapiens
  CDS (428)..(835)
tgtattggtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtc

SEQ ID NO: 27 - DNA, 2658 bp, Homo sapiens
  CDS (265)..(2148)
cttgaatagatcgcctgcggtaccgctccggaattcccgggtcgacccacgcgtccggtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatgaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattgggagtagcaattcttcaggcagctgcgggaccggcttttgggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaagaaaaaaaaaaaaaaaa

SEQ ID NO: 28 - DNA, 4040 bp, Homo sapiens
  CDS (40)..(1782)
gcacgagggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgctagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgccccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcccgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgtaaagttaaaaaaaaaa

SEQ ID NO: 29 - DNA, 1813 bp, Homo sapiens
  CDS (221)..(1189)
agcgattactcactatagggctcgagcggccgcccgggcaggtgttcccccgaagtttagagtgaagatttttccacctggacacctgaccatgtgcctgccctgagcagcgaggcccaccaggcatctctgttgtgggcagcagggccaggtcctggtctgtggaccctcggcagttggcaggctccctctgcagtggagtctgggcctcggcctcaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagccgaatttataaagtcccgagacttcctgggcaaagaatggccaatcagtttccttcctgggtcgatgtcgatgttgtctgggcaggaaaaccagtttttgtgtaaagaaggtaaattttctgacaccttttgaaatttagttactaataagccctactgtaatttagcccagtttaactcccccctcatttaaacttcctttgattttttccgcccatgaaaaagggcatagtttgcctggagaatcccctcccgttcataaaaagaatgttgatggcaaaaaaaaaaaa

SEQ ID NO: 30 - DNA, 3650 bp, Homo sapiens
  CDS (319)..(1452)
gcatgatgtatataactatctattcgatgatgaagataccccaccaaacccaaaaaaagagatctctcgaggatccgaattcgcggccgcgtcgacctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagtggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccacttcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcaaaaaaaaaaaaa

SEQ ID NO: 31 - DNA, 2299 bp, Homo sapiens
  CDS (335)..(1417)
gcacgaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaaaaaaaaaa

SEQ ID NO: 32 - DNA, 1558 bp, Homo sapiens
  CDS (50)..(1174)
taagcttgcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaaaaaaaaaaa

SEQ ID NO: 33 - DNA, 1181 bp, Homo sapiens
  CDS (173)..(874)
cggcccccccattgaaaccggatgctgtacgcctgcggtaccggtccggaattcccgggtcgacccacgcgtccgggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatctaaaaaaaaaaaa

SEQ ID NO: 34 - DNA, 1206 bp, Homo sapiens
  CDS (135)..(965)
atgaacccctgtttgaccgcctggggtaccggtccggaattcccgggtcgacccacgcgtccgatgagggcacggccttgtaaagaaacccaaagcagcacagcctctgagaactgaataatggccccttccagatgcctctttgcaatggtggaaatttggcagtaacaggttcctgggcagatcgatcaccactacatgaagcagcaagtcaaggtcgccttcttgctctgagaacattattatcacagggttataatgtaaatgcagtaaccttagaccatgtcaccccattgcacgaagcctgccttggagatcacgtggcatgtgccagaactctgctggaagcaggagctaatgtaaatgcaatcacgatagatggcgtgactccgttattcaacgcatgctcccaaggcagtccaagctgtgcagagctgcttctggagtatggtgccaaagcccagctggagtcatgtcttccatccccaacgcatgaggccgccagtaaaggtcaccatgaatgtcttgacatcctgatatcctggggcatagatgttgaccaagaaattcctcatttgggaactcctctctatgtagcttgtatgtcacagcaattccattgcatctggaagcttctttatgctggtgctgacgtacagaaaggcaaatattgggatactccattacatgctgctgctcaacaatccagcacagaaattgtaaacttactgctagaatttggagcagatatcaatgccaaaaatacagagcttctgcgacctatagatgtagctacgtctagcagtatggtggaaagaatattgcttcaacatgaagctaccccaagctctctttaccaactttgccgactctgtatccgaagctacataggaaaaccaagattgcaccttatcccacaactccagctgccaacgttactgaagaatttcttacagtatcgataaaacagtaaagtaattctaaataccttgaaaatcaaaatttctatttcttttgcttaaggaatagttcatataaaaatatgctaaagataggataaaagtgagtgtgagatcacccagggaagcagtaaaatatcaattttcattttaagtgtattagtactattgttttatcatttatgctgtctttggatacgaaatcgtcgacagcgaagtcgacccgggaattccggaccgggtacgt

SEQ ID NO: 35 - DNA, 2119 bp, Homo sapiens
  CDS (520)..(1614)
gggaggagcatcactgatggccactatctacacccctgagcgtctactcctggccatctatacccctgactgtctacacctccgatcatctacacccgacggtctacacccctgacaggcttctcctgtcgaggtggctccacacactggggagggaagacgcccacctgccggaacagcggtccagctgcttcctgatggatgatgggggagagccgagttctggggaagggctggtctaaggggccttcccaagttcaccgataggtccttaaaggctgctttgctcaaagtggcccaggagaagtggggaggggggagggcattgcctgacgacatcgtgacctcctcatgccctatgacctagggggcttggctcctggtttctgatcagacctctgttctcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgaaaaaaaaaaaaaa

SEQ ID NO: 36 - DNA, 1364 bp, Homo sapiens
  CDS (48)..(1364)
gctggagaatcctcatccaggagcgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtga

SEQ ID NO: 37 - DNA, 1030 bp, Homo sapiens
  CDS (73)..(855)
tcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctagcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcaaaaaaaaaaaa

SEQ ID NO: 38 - DNA, 919 bp, Homo sapiens
  CDS (73)..(744)
tcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctagcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcaaaaaaaaaaaa

SEQ ID NO: 39 - DNA, 4849 bp, Homo sapiens
  CDS (355)..(3744)
tttcgtgtggaagacaaggccagcgcctatgaggaccagctgcagggtcaggcacagcaggtggagaccctgcagaaggagaagctgagcgccactttcgagggcagtgagcaggtgcaccagctggaggagcagctggaggcacgagaggccagcgtgcgcaggctcgcagagcacgtgcagagcctctgtgacgagcgggacctcctcagacagcggttccaggagctgacagagcgcgtggccacgtccgacgaggatgtggctgagctccgggaaaagctgaggagaagagaggctgacaaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaagagattttaaggaaatttgcaagtgaatctccaaaggacatggaagagccacggagtacctctgaagagacacaaagggatggctctttgctcccaggtcaaccagtccaagcctctagggcacctgtaggcctcccacactcaaggctcgaggatgaggacgaggacctgggggctcctccgggggaagagtacggtgatggcagccccagtagggaagacagcatggtgcccccaaagtcagtggaagtgcttgacagggagggccatcagcagggcacagccaaactcgaccaaggggcacctggtgttaaaaggcaaagaatccggttctccacaatccagtgccaaagatacattcaccccgaagggtctgagaagacctggaccagcagcacatcttccgacaccagccaggaccggtcaccctcggaagaaagcatgtcctcagagcctgcacccagtgtactgcctgcaactggcgactctgacacgtacctctccatcatccactccctggagaccaagctctacgtcacagaggaaaagctcaaagacgtgaccgtgaggctggagagccagcagggtcagagccgtgaggcactgctcgcactgcaccaccagtgggcgggcaccgaggcccagctgcgtgagcagctccgcgccagcctgctccaggttggcgcactggcctcccagctggagcaggagaggcaggagagggccaggagggttgaagggcatgttggagagcttggggacttccaggtcaagaatagtcaggccctgatgtgcctggaaaattgccgagaacaactgagatctctgcctagggccagccaggaggatgagcaggacgcacgcgcagcctccctggccagtgtggagagtgcactcgtcagcgccatccaagccctgcagcactggccggccccagcccatggcggggcccgtgcacagctggagacaggtggcaccgaggagaatgggaagcctgcctccctgcagcagtgctcccagtctgagttgacagagcaggagcaggtgaggcttctttctgaccagattgctctggaggcctcgctgatcagccagatagcagattccctgaagaacacaacatcagatgtctcccgaatgctccatgagatttcttggtcaggacagccaccgatggaatctgctggggcccccgtagacacctgggccaggaaggtcctagtggatggtgagttctggagccaggttgagtctctgaggaagcacttggggacactgggaggagaggcagtcggtgcctcaggagacgggcagcaaagcatcccacagggcctggcccccatcctggccaatgccacatgggtcagggcagagctcagctttgccacacagtcagtgagggagtcgttccaccgcaggctacagagcatccaggagaccctgcggggcacccagacggccctgcggcagcacaaatgcctgctgagggaaatcctgggagcctaccaaaccccagactttgaaagagtgatgcagcaggtcttggaagccctcaggcttccagcgggccatgaagatggtgttcagctgtcctgggacctgagccccttaggagaagtcctgggccgagactcagacagctctcaggagcccttcgatgtgtctgaccagagccctggggcctttgttgctattcaggaggagcttgcccagcagctgaaggagaaggccagcctcttagaggagatagcggctgccttaccatctctgccacctgtggaatcgctgagagattgccagaagcttctccaggtgtcccagagtctctcgtataacacttgtttgggaggcctcggtcagtattcttcattgttggttcaggatgccattattcaggcccaggtttgctatgcgtcctgcagaatccggctagaatatgagaaggagctccagctctgcaaggagtcctggcaaacccgggagccctcctgctcagagcaggcacaggcagcccgggccctgagggaggagtatgaggagcttctccgcaagcagaagagcgagtacctggatgtgatcgccattgttgaaagggagaatgcagagctcaaggccaaggccgcccagctagaccatcagcagcagtgtctggaggatgcagagagcaagcacagcatgagcatgttcaccctgcggggcaggtatgaaaaggagattcggtgtgtggtggagcagctgaccaggaccgagagcacactgcaggctgagcgcagccgggtcctgagccagctggatgcctcggtcagagacaggcaggacatggagaggcatcatggtgagcagatacagaccctggaggacaggttccagctcaaggtccgggagctgcagacgatccacgaggaggagctgaggaccctgcaggagcactactcgcagagcctgaggtgccttcaggacaccctctgcctccaccaggggccacaccccaaggccctgccagcccctgcccccaactggcaggccacccagggagaggctgactccatgacggggctgagggagcgcatccaggagctggaggcccagatggatgtcatgcgggaggagctgggacacaaggacctggagggcgacgcggccacactgcgtgagaagtaccagagggacttggagagccttaaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcccattaacttaaagggttaatggcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcaacaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagacccacacccctgagagtcgtggcaaacctttcacaacctggaaaatgttgaaagcaaccattcctatttttgtttgttttttattaaatcttgcacaaaatccccggcccctctccttccttcc

SEQ ID NO: 40 - DNA, 5199 bp, Homo sapiens
  CDS (241)..(3156)
ggaaaccaggccgaaccccaacccccaccaaaaccacctactcttgttctgtgggaggccagtccacatacgctttgacccgagagagatattcagatggatccaatgtgactgatgaagggaaggaaatcatgtctagcgaagccttgaaaaagctgccctgagacggagtgccgccgaaagaatggtggctcaattaagaaacatcagggagataaatgccacccagtgaggctaaaaatgactacaaaccgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatagtggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtacgtgaaggtggtgctggtgggttcactttccaaggccagactaaaacagttattttctataaaaatctggaagcaaagaatggggatggggagagctacctggtagtatgtttttattaggagaataatgcaataaaatatgtaatggcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgagttatggaaatccactga

SEQ ID NO: 41 - DNA, 5640 bp, Homo sapiens
  CDS (549)..(5354)
ccactttgtacaagaaagctgggtacgcgtaagcttgggcccctcgagggatactctagagcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaccgaaaaaaaaaaaa

SEQ ID NO: 42 - DNA, 1887 bp, Homo sapiens
  CDS (55)..(1563)
cgcggtaccggtccggaattcccgggtcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggccaactcaacaagagcaaaacacaaaggctgctaccaagtgttgttgtatttcagttcctttcataggcctccgaggtggccattgactatttggggtatatatggcatatttattttatctagagtagctgggg

SEQ ID NO: 43 - DNA, 1416 bp, Homo sapiens
  CDS (240)..(1097)
ctatacgactcactatagggaatttggcctcgagcagtaattcggcacgagggtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctgatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaaaaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttcaatttaaatacatacttatgtttgtattaatctatcaatatatgcatacatgaatatatccacccacctagattttaagcagtaaataaaacatttcgcaaaagattaaaaaaaaaaaa

SEQ ID NO: 44 - DNA, 2401 bp, Homo sapiens
  CDS (73)..(1752)
cctgccaagccaatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgatgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgttttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccggcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatt

SEQ ID NO: 45 - DNA, 2905 bp, Homo sapiens
  CDS (173)..(2452)
ccttgataatcgtcacgactgccggaccggtccggaattcccgggtcgacgatttcgtagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacattctaaatactagagataactttacttaaattcttcattttagcagtgatgatatgcataagtgctgtaaggcttgtaactggggaaatattccacctgataatagccttttttttctttatttccatatggcaatattaaggtagacagatgattagtagtatattgttacacactatttttgaattagagatcatacagaaggattttaggggcttaaacattacgactgaatgcactttagtataaagggcacagtttgtatatttttaaatgaatacca

SEQ ID NO: 46 - DNA, 585 bp, Homo sapiens
  CDS (157)..(444)
gcgctgcaggcaccgggccggaattaccgggtcgacgatttcgtgcggggcccgccgaggcccggcttctgtcctgcgcgcgcagattctcgcaaatctggaagcggatcgcgtggagtgacggtcacaccgcggcgaattaattcccaaagactcatgttacatgagaaagccaccaagaagaccaaagaaaaggagacaaggatggctcttcctcagggatgcttgactttcaaggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaaatataggaacccgggctccctgggattttttctaaatgtgagacaag

SEQ ID NO: 47 - DNA, 2497 bp, Homo sapiens
  CDS (107)..(1756)
  misc_feature (1)...(2497): n = a,t,c or g
gagggnnnnnattgatcgcttgaggtaccggtccggaattcccgggtcgacccacgcgtccgcttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccaggcctgaccgccgggctctcctgcagttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggctttggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaacctgtgttgtgtgttggcggttttgggggcagggctgagagctgagctgcgggtcttggggcaggagcaggacatatggtcagtggcccatgggagccagggttggagggaatggggttgcagcgtgaggagacagacctcagcgccagggtccccagacacccagtgcagcccacagtgggcagggtcacaggtattcagaggacctggggttcagtgcaggtccctgggctgtgaggccccttgtctgagggaaaggggccctggttctgtgcatgggacagaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaaaaaaaaaaaaaaaa

SEQ ID NO: 48 - DNA, 2597 bp, Homo sapiens
  CDS (592)..(1272)
tacgcgccctgataagcagaatggcatcgttccggtggtgggcgttgatggctggtcccgcatcatcaatgaaaaccagcagtttgatggcatggactttgagcaggacaatgaatcctgtacatgccggatttaccgcaaggaccgtaatcatccgatctgcgttaccgaatggatggatgaatgccgccgcgaaccattcaaaactcgcgaaggcagagaaatcacggggccgtggcagtcgcatcccaaacggatgttacgtcataaagccatgattcagtgtgcccgtctggccttcggatttgctggtatctatgacaaggatgaagccgagcgcattgtcgaaaatactgcatacactgcagaacgtcagccggaacgcgacatcactccggttaacgatgaaaccatgcaggagattaacactctgctgatcgccctggataaaacatgggatgacgacttattgccgctctgttcccagatatttcgccgcgacattcgtgcatcgtcagaactgacacaggccgaagcagtaaaagctcttggattcctgaaacagaaagccgcagagcagaaggtggcagcatgacaccggacattatcctgcagcgtaccgggatcgatgtgagagctgtcgaacagggggaagatgcgtggcacaaattacggctcggcgtcatcaccgcttcagaagttcacaacgtgatagcaaaaccccgctccggaaagaagtggcctgacatgaaaatgtcctacttccacaccctgcttgctgaggtttgcaccggtgtggctccggaagttaacgctaaagcactggcctggggaaaacagtacgagaacgacgccagaaccctgtttgaatttacttccggcgtgaatgttactgaatccccgatcatctatcgcgacgaaagtatgcgtaccgcctgctctcccgatggtttatgcagtgacggcaacggccttgaactgaaatgcccgtttacctcccgggatttcatgaagttccggctcggtggtttcgaggccataaagtcagcttacatggcccaggtgcagtacagcatgtgggtgacgcgaaaaaatgcctggtactttgccaactatgacccgcgtatgaagcgtgaaggcctgcattatgtcgtgattgagcgggatgaaaagtacatggcgagttttgacgagatcgtgccggagttcatcgaaaaaatggacgaggcactggctgaaattggttttgtatttggggagcaatggcgatgacgcatcctcacgataatatccgggtaggcgcaatcactttcgtctactccgttacaaagcgaggctgggtatttcccggcctttctgttatccgaaatccactgaaagcacagcggctggctgaggagataaataataaacgaggggctgtatgcacaaagcatcttctgttgagttaagaacgagtatcgagatggcacatagccttgctcaaattggaatcaggtttgtgccaataccagtagaaacagacgaagaatttcatacgttagccgcatccctttcacaaaagctggaaatgatggtggcgaaagcagaagcagatgagagagaccaggtatgacaaccacggaatgcatttttctggcagcgggcttcatattctgtgtgcttatgcttgccgacatgggacttgttcaatgacacctcagcaggaaaacgcccttcgcagcattgcccgtcaggctaattctgaaatcaaaaaaagccagacagcagtttccggataaaaacgtcgatgacatttgccgtagcgtactgaagaagcaccgcgaaacggtaacgctgatgggattcacaccgactcatttaagcctggcaatcggcatgttaaacggcgtctttaaggaacgatgaacatgaaaagcaaaatcatcagggagctacaggctccttttttattattcgcattcaccctcaagcgtattaaccaacagttcagggattaatgaaagatggcagacatcattgattcagcatcagaaatagaagaattacagcgcaacacagcaataaaaatgcgccgcctgaaccaccaggctatatctgccactcattgttgtgagtgtggcgatccgatagatgaacgaagacgcctggtcgttcagggttgtcggacttgtgcaagttgccaggaggatctggaacttatcagtaaacagagaggttcgaagtgagcgaaattaactctcaggcactgcgtgaagcggcagagcaggcaatgcatgacgactggggatttgacgcagaccttttccatgaattggtaacaccatcgattgtgctggaactgctggatgaacgggaaagaaaccagcaatacatcaaacgccgcgaccaggagaacgaggatattgcgctaacagtagggaaactgcgtgttgagcttgaaacagcaaaatcaaaactcaacgagcagcgtgagtattacgaaggtgttatctcggatgggagtaagacgaaatcgtcgacccgggaaaatcccgcggccatggcggccgggagcatgcgacgtcgggcccaattcccctatagtgagtcgaatg

SEQ ID NO: 49 - DNA, 2286 bp, Homo sapiens
  CDS (69)..(1727)
tctgtgtgcatgagcccctgcggatccgccgacttctccgtcccttcttcctgctgcagaactcctctatgatgaagaagaccttgaaatgcatccgctggtcgctgccggaaatggccagcatcgggctgctgctggccatccacctgtgcctcttcaccatgttcggaatgctgctgttcgctggagggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctacggcagtgttctgctgtcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccgaggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaaaaaaaaaaaa

SEQ ID NO: 50 - DNA, 3114 bp, Homo sapiens
  CDS (626)..(2614)
gttaccgctccggaattcccgggtcgacccacgcgtccgcggacgcgtgggcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgactctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaaaaaaaaaaa

SEQ ID NO: 51 - DNA, 442 bp, Homo sapiens
  CDS (58)..(336)
gctccggaattcccgggaacatttacactgacagcaagtacgccttagctactgtgcatgtacataaagccatctaccaggaaatcaggctactcacctcagcaggtagctgtgatccactgcaaaggacatcaaaaagaaaacacggccgttgcccatagtaaccagaaagctgattcagcagctcaggtcactgccagactttcagtcacgcctccaaacttgctgcccacagtctcctttccacagccagatctgcctgacaatcccgtatactcaacaacaacagaaaaactggcttcagatctcagagccaataaaaatcaggaaagttagtagattcttcctgactctggaatcttcataccctgaacttaaaccagttacctacagtctaccacccatttaagaagagcaaagttacctcagctcctccggaggg

SEQ ID NO: 52 - DNA, 3735 bp, Homo sapiens
  CDS (1890)..(2096)
  misc_feature (1)...(3735): n = a,t,c or g
ctctgtggccccactcctccctcccatgtgtatgctntgagccgttccttagttgagtaggtgattgaccataccagcagcactggtgccaattaagcggtctgcttggttcacacagcctttcattcctgttctagcatggctctgtcttaaatctgcatgcatgtatttattccttaatatattacctctcttcctttcttcctttttacatttcttcccattttttattgtttctctctctctcactctctcactcattctctcttgcactttgtcttcggagctcattgccatggagtggcttggctgtacgcatcaaaaagccacccgcaaacgtccatccttggccgtgcggttccacgtctcactcattacttccttcctgcattcatagcatccttccttcctgcttgctctctttttattaggcatttattcctctattagtggagtcaggtgcccttatgacaagtcctagcctaactcttctcgtggatctacccatttatccatttggttgttatttctttttaccgttcctttctctcttctgtcatagctttccatacctcctgtccttcattttcatgcagctggggtgcccaggggggaccccaacaccctcatcaggaggacccatggggccatgtcttctcattcacctcatccttgtctatttagatactcactgacttgttcacttagatgttcattatttaatggacagcctgtggttttctagaagtggaccagccatagcccttaatctgtgatgatcttttgccaccatcgatcgcattgccttcttttacatctttatttaccacccattaatgtatttctgtacttaacatttgttacattgtttcctatttctttatttaccaatattacctttctcatatcctttcatctaacagacctcagtgcccaggactggatgactcaaaacccctcacaacatcttgtcacctggcgctgcactcccactgctcattcatccatccacacacgcaatgtagactttttggcctttttttctttcttttgtcatttatttatttatgtgcagacttcaagtgctcaggcttagataacttttggtaaaagtacactctcatctttcgcccactgggtcctctttctttctttgctattctttgaactcgttctctgtggtttatttttctatgccaggagcatatattatttgtatcagtcctaatgcttagcttacaatagtctgacatggtcctccttacagagttactcattactcatcctctagtctgtttttttttttaacctttctttgttgttttggttttttaaaaaaaacctttcccttctcccttttgatcacttgttccctaacttgcatcttttcattttgacgggcctcaaaatctatgtctcattctgcacttcactactcatacatccattctttctttcatttaggttctttttcattgtcaaatgtcagaggcatatatttgagttacacataccccttagtccataatcacctgatatcgctttgtgtgttgccctattacttagtgattcactggtttttttctatttatatattgattgcctagccatcaaagcggatgaaccatggtcttgtgtacacacactctcatcctggcttgcttacttctttacctatttacttgtttattcattctctcttgcttcactcattcattcatctggtcatttattatacaatgcaatagataccagtgaaacaacctctcaacaacaacagcaacaaaactcagaacattcacagtatctttggcattcctgcttcttctcactgagtcaccaaccaaggtacacacagcccacagtccagaaacacacacaaatggcggatgcagagcagagacacagtgaatgttaagtttactcccagatccttctggggctcgcgtcctaaacatactgggggcagatctgagatgagggcccacgttccccaggccccctgggcaaggcaagcgccgcctgttctgcccctctggaccgtggtgaatgaccatccccatgagaaacctgtttcaagaccccagaatacatagagacacacacatggtacatagtctcctggtgggaaacgacggacatggagttcatttttaaataggtggctttgtctgtggcaatataaaaatattttggcctttcaaggcaaatacaaaagaaactacccattaacatggctgagtgtctcagtcccaaacaataaagaacttgaagaggtttagccggaaactttgaagacagaaaatctgcccattatgttttccagacatttcgagggggcgagcggaggtcattggagcttgaagcccatttggaaggctggtccctcggcctgcgttttctccttggccctttgaagggccccccagctcacagggcacttccatcctagtctgccgatttcgagctggagaggggctggggtcccacattcgaggtcccttcccacgtaggcatccaggtgatggcttccgcccaaaccaggaaggagacgagaggcccgccaggaagaagacttgggtccgggatggtgggccccatcagggcctcttccgcagcttccatccgcagttcttcagccgacccagccgggccacggcccacgtgcctttgtgagcgtgcttccacggagtagagcgagtcaggaagcagtgggttgaagaggaaattggaggtgaggaaggaagacagcaagtgtagacaggcctttcaagaagcttggctgatgcaaggagagcccgtggacaagggctgcctggagtgctgttggagaataaataagacaagtaagacaagcaagaggggtgggaagggactgacctgtcaaaccttttcaacaaacatttgctgatcacctcctctatgccagatcctgcctgaggcctcttttatctcatttaattctcacaacaaccctaggaggttgctctcatcgaccccattcccccagaaaaggataggaagatcttcagagaggtggggcgtgcctttggtgattcagtagcatgctcattccagaagcccacccagggccttggagttgccagcaggatgctggccaagcccttggcccaggtccccctcctgagaatttcccaaagggatccttccattcaggacatcataagggtgatgacagagtcagtcgacaaagactgacacccccttggggagggaaacactccagtttgctagcaggtgaacacaagcaaagacttataggaaagtactcatagagtcaaagtatgagcatagcaaaggtcagggcttaatgcccaatgccccctcactagggcattggtttaagtctttaggtaagagggacagctggctggtcagttccggtcctcttcatcctttgccatcctggtcctgggggtcagtgagtggctgctttgtatgttggtgggatccaggaaaccgtgctcctagtgccctcgtgaggtgtagatgggcagcaggccccttggcagcagctcagcatggagaggaggtggtccttgaagacaaggaggtggacggatgatgtcatccctgaggagagacccgggtgagggatcctctcgtgggcgccccagctctcctgaggagccgccgccaaggccagcgagccaaggcgcgctccctctctgccggacgcgtgggtcgacccgggaattccggagcggtacctaa

SEQ ID NO: 53 - DNA, 2868 bp, Homo sapiens
  CDS (431)..(1924)
  misc_feature (1)...(2868): n = a,t,c or g
aaggatccttaattaaattaatcccccccccccccccgagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgncgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagatctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggcacaacccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaaaaaaaaaa

SEQ ID NO: 54 - DNA, 1699 bp, Homo sapiens
  CDS (193)..(1533)
tcatttcagcgacgtggaattcgatggaatgtccatacccttcaccctcatccaagagcagtgtgggctgggatagggaggggacatgggtcataggctcttctaggtagagccagggccccggcgttgtgctttcccacccttctagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaaaaa

SEQ ID NO: 55 - DNA, 7263 bp, Homo sapiens
  CDS (159)..(5057)
actgatcatcgaacggctgatgtatataactatctattcgatgatgaagataccccaccaaacccaaaaaaagagatctctcgaggatccgaattcgcggccgcgtcgacgccagcagtgctgttggaactgctctgccaaaatttgccatccgagggatgctgaaaacctttgggcttcatggagtcgtcttagatgttgattcagtgaatgaactggtgcaggtagaaacgtacctccgcagtgaaggtgtgctggtgcgatactggtatcctattgacatgttggaaaggcccccagcaggctaccgaaggactgccaccaatgggctggtcacactggacaataccaaccttcaaattcacagggagctgctgcgctgcgaggctgcgctggccaggctgtactgccgcatggccctgctcaatatcttcgccccgaagttgcctcacttgttcactcgcctcttccacatccctgccatccgggacattaccctggagcacctgcaactgctgtccaatcagctcctcgcacctcctctcccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcagacagcaccagagcagttcccctccgaagagttcccaatttccgaatccaaagtcaacatggacgtgaatttccccggggcagcttttgttgttgtgtcttgtaaagaaagtcaatctggattccgcaaagactcctctctgtacaaggcaccgtgggcacgggtgctcgtatatggcctcggccacaaagtgaagcgaaatggccagctgaacctcatcgaggccgcctgttacccgcgggacgcgtccccagccaacactgggcttgcacctccccccaccgctgaccagtacccctctgtggtcctctccacagacagggtccacatcaaactgggggtgtctccacctcctggagcagtcctggtgttacattccctgcccctggagttcccactggctatggccttcgcagagcagctgctgtcctggaaatcagaggacagtgaagggaagtccgaagatgagcctgacaccattccgacatccgtcctcctgcaggtggtggagctgctaggaaacttcttgtggaccacggacatggcagcctgcgtgaaggagcttgttttccatctcctggcagagctcctgcgcacggtgcacaccctggagcagaggcggcaccccgctggcctgtcctcctcaatcgccctccagctgaacccctgcctggccatgctgatggccttgcagtcggagctccacaagctgtacgacgaggagacgcagaactgggtctcaggcggcgcctgcgggggctccgggggggcggcggccggtgaccagggcaggttctctacgtattttcatgcactcatggaagggtgcctggctgtggccgaagtgaccctgcctactaacatgagtgtcacagccagtggggtgacctcagcgaccgccccaaatctcagtgactcgtcctcctcctcctcgtcctccccaggacagaccccacagagtcccagcctcctctccaagaggaaaaaagtcaagatgaagcgggaaaaggcctcctcgtcgggcaagcgccagtcttcccgcaccgtggactcggaccccaccgtgctcagcatcggaggcagcaagcccgaggacatgctgtggttccaccgcgcactcaccctgctcatcatcctccgccacctcaccaggaaggacccacaggggctgggcgtgacgagtgacgccatcgccgatgcctgccaggccctggtgggccccaccgcccacagccgcttgctggtgatctccgggatccccacccacctggacgagggcgtagtcagaggcgccatccgcaaggcctgcaacgcccacggcggggtcttcaaagacgagatctacatcccgctgcaggaagaagacaccaagaagccaaaagacaaggccgagggcggggacgggaaagttgagcccgagaagacactggccttccccggcacagacagcatggaggtcagcacgtccagcagcctgacccccgccatgagcatcagcgcctccgcctccaccagccaggcctccatctgcagctcgcagggcatctcccaaaccgtcagcgacctctctgtggatccgctgcctgccggcctcgagctgcccatccctccgggcctgttggagccccacgcggtgtccagccaggaaagcctggacatttccctgtgcagcaccggcagcctgggcagcctgggcagcctgggggagcccctggacaatgcagagacggcctcggtgtcggacatgggctccatgtacacagtcacttccctggacaaccagcccctcgccgcccgccccatcaaaggcttcgcagtcgtggagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagttgtgcccattcagagcagacgctgagcctgacaccagcgaagcccatcagagtctctgacatttatcttagcaaagagcagatcaactcccagaccccaggcaacctcctccacctcttcttcaccaatgtccggccgccaaaaaaggtgctggaggatcagctcacccagatcctgaggaagtatggcgtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatccccatgaggtgtacctggaccccgcggatgctgctgaccccagagtggcctgtctcctgaacgtgcccatcgagagcctgcgcctgcgcttcgccttgctgcagtccctcaacaccacactggagaccttcttcctgcccctggtggagctgcgccagacacccatgtatacccacagcatcgccgccctgctgaaggaggccaaagggctgatcttctatgacacgaaggtgaccgtgatgaatcgagtgctgaatgccactgtgcagaggacagcggaccacgcggcccctgagatcaccttggacccactggaaattgtgggaggggaaatcagagcttctgaaaactcctacttctgtcaggctgccaggcagctggcctcagtgccgtcgtctcagctctgcgtcaagctggccagtggcggtgaccccacatatgccttcaacatccgcttcactggcgaggaggtccatggcaccagcggctctttccgccacttcctgtggcaggtgtgtaaggagctgcagagttcctcgctgtcgctgctgctgctgtgccccagctcagctgtcaataagaacaagggcaagtatatcctgaccccgagccccatcacctacggggaggagcagctgctgcacttcctggggcagctgctggggattgcaattcgggcagacgtcccgctgcccctggacctcctgccctccttctggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggagttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatggggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattataaaaaaaaaaaaa

SEQ ID NO: 56 - DNA, 1159 bp, Homo sapiens
  CDS (183)..(1064)
atttggccctcgaggccaagaattcggcacgagcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctctaaaaaaaaaaaa

SEQ ID NO: 57 - DNA, 6260 bp, Homo sapiens
  CDS (192)..(5339)
atgtaccgctccggaattcccgggtcgacgatttcgtagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagcagaaaaaaaaacatgaattctttttctggaaaatcagggagacatgggtaataataggtactaataaatatttatagatgagtgaatgaggaaataattac

SEQ ID NO: 58 - DNA, 3116 bp, Homo sapiens
  CDS (522)..(3116)
tacgcctgcgcgaccggtccggaattcccgggtcgacccacgcgtccgaacccaatccaccttactaccagacaaccttatccgaaccatttacccaaataaagcataggcgatagaaattgaaacctggcgcaatagatataggaccgcaagggatagatgaaaaaaagttgcctgtgaaggagcgaataatgatccagatgagtctatgagttctagaatttcaaacacggaaagatctcataaggatgctcacacagttgaagaagagtctctgaccttatcaagggaggatgcagagcaggttgcattataagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgccgtccactgaaaaagttgagaggagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagtgaaatttcctcaaaggaagaggtactagagaagattcttgtctctggggaaatggcggcagcattgagagaaactgtaagactggacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcaggtatgtatttttctgtcctttaaaagttttttgaatgctttttcagaggaaataaataattccatgattattttgtccttaagtccaacaacatttaaaaatctctaa

SEQ ID NO: 59 - DNA, 1380 bp, Homo sapiens
  CDS (57)..(1193)
ttcgtcgcgtccgcccggaatccaactcgacccacgcgtccgggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgagctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtcaaaaaaaaaaaa

SEQ ID NO: 60 - DNA, 1748 bp, Homo sapiens
  CDS (529)..(1308)
cttggcacgcataggggaggctgatgtatataactatctattcgatgatgaagataccccaccaaacccaaaaaaagagatctctcgaggatccgaattcgcggccgcgtcgaggcggcggtggcggcagcggttgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgggggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcag

SEQ ID NO: 61 - DNA, 2765 bp, Homo sapiens
  CDS (123)..(2291)
tcactatagggaaagctggtacgcctgcaggtaccggtccggaattcccgggtcgacccacgcgtccggcttttcctgctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggcccaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcccaaaaaaaaaaaaaaaaaa

SEQ ID NO: 62 - DNA, 805 bp, Homo sapiens
  CDS (29)..(643)
ctagccagtgtgttgtaattccgcagccatggcctggaccgctctccttctgagcctccttgctcactttacaggttctgtggcctcctacgaggtgactcagtcactctcagtgtcagtggccctgggacagacggccaggattacctgtgggggagacaacattggaagtaaaaatgtacactggtaccaacagaagccaggccaggcccctgtattggtcatctatagggataccaaccggccccctgggatccctgagcgattctctggctccaactcggggaacacggccaccctgaccatcagcagagcccaagccggggatgaggctgactatttctgtcaggtgtgggacagtagcgcgtatgtggttttcggcggagggacccagctgaccgtcctcggtcagcccaaggctgccccctcggtcactctgttcccaccctcctctgaggagcttcaagccaacaaggccacactggtgtgtctcataagtgatttttacccgggagccgggacagtggcctggaaggcaaaaagaagccccgtcaaggcgggaaggggaaacaaccaaacctttcaaaaaaaggaaagaacaaggaccgcgggcagccatcttacctggaccccgaccccctgagccaggggacagccccactaaaacacttccggttccctcgtttcccccttgaaagtgttcccccggggtaaaaaaacctgggcccccttacaaaaaaggttgttgggtgtttctttcccctccccccccccccccggggggagtgtttgaacgtctcgtctc

SEQ ID NO: 63 - DNA, 1566 bp, Homo sapiens
  CDS (133)..(1095)
ggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccagggctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctgcaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactccaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacaaaaaaaaaaaaa

SEQ ID NO: 64 - DNA, 2448 bp, Homo sapiens
  CDS (352)..(2448)
ttgggagtaaagagcccgctcgcagcctgcatcgccggggctcgggacataagtcatcggcggggaaatggggctctgtcactttaagtacagctggagccctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcatagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaaggtaggacatccagccacagattgagagggaacagggagcaggaaagtaagagtattacagatttttatctgggcccatag

SEQ ID NO: 65 - DNA, 2155 bp, Homo sapiens
  CDS (143)..(2032)
  misc_feature (1)...(2155): n = a,t,c or g
ttctgaacgacattgctaggaccacgattacgccaagntnnggacgagggggactttgagatgtgtgaatattcatcagcatttgcttgtggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaataaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaaaaaaaaaaaa

SEQ ID NO: 66 - DNA, 2471 bp, Homo sapiens
  CDS (56)..(2224)
  misc_feature (1)...(2471): n = a,t,c or g
gcacgagagctccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcangaaggaacctgagcaggacccccacctgaagtagaacttaagagaggggccaagtgtangattggggaccatggtctgggagctgttctggggcangggggaatatgcaagctaaaagcccctctataccctggtagggc

SEQ ID NO: 67 - DNA, 2590 bp, Homo sapiens
  CDS (386)..(2194)
cggtactagcagctgggagtactgtgagcctgccaccacatctggcgactttgtgtatatgacgtagagaagggggtacagcatgtcgtccaggttggtcttgaactcctgacctcaggtgatccagccactttggcctcacaaagtgctgggattataggcaagagcgatggcgcccggcccactcagcaggattcctagaatgggcacgagctctgccctcatcacagtccaaaagtgagcacctgcctggagctgcccagaaacagccttgtggggtggggttggtgtctgacctccctccccgggggccttcgcaggcttctctgctggtgcttctgtgcctgtgggtctggattcctccagggcctgatcctgggtgcagatgcagctggaagccctgaacctgctgcacacactagtctgggcacggagtctctgccgtgccggagctgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgccgggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaagccgccctgtcagctggccggtccaagcctgtggctggagctggtgtgtgtttatctaataaagtcccacaggtgcctcaaaaaaaaaaaa

SEQ ID NO: 68 - DNA, 1956 bp, Homo sapiens
  CDS (76)..(1665)
  misc_feature (1)...(1956): n = a,t,c or g
ggaattcccgggacgacccacgcgtccgcccacgcgtccggcgcgcactgcgggtcctgattggttgtgcacgccatggtgaaaaacttgagcggctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacggtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggtatttctattgcttttgcttgcttatgtgaatgcatgaatatgtgtgtgtgtacatgcgtgcattcagagaattaatcaagtgtttaggacttgtattgaaaccacttgtggttgagtaggaaagatccaataccatttaatccctttacttactagttatttcaaccatttaacaatactgccattgacctgacagtttgtgtctgcccttttgcgtcgacgcggccgcgaattcggatcctcgagagatctctttttttgggtttggtggggtatcttcatcatcgaatagatagttatatcatcgacccccaatnnnnnccccacg

SEQ ID NO: 69 - DNA, 1690 bp, Homo sapiens
  CDS (128)..(1522)
ccggaattcccgggtcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggctcagaacaacgacagcggccgctctagaggatccaagcttacgtacgcgtgcatgcgacgtcatagctcttc

SEQ ID NO: 70 - DNA, 1911 bp, Homo sapiens
  CDS (162)..(1067)
ctgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccgggggggagaattttctcaatgggagacggttgcactttctgtgccccacggagtttgtggctccccgcggcagacccctccctcattctcctccctgacctttccatcttcctctctgcttgcgagaaaatgtcagtagttcccagagaagtcgggggtacccatacccgggcttacctccacaccttggggcctaaaacagccgtctcctggggttattactaatacgacaagaggagattccagttttggttatagaatgggttttccagaaacattcctccgggggaatg

SEQ ID NO: 71 - DNA, 1823 bp, Homo sapiens
  CDS (247)..(1458)
gacgggcgaactcctgtgaccccgccacgatcgtgcacaacttttcccgaaccgagccccggactgttcctgtttggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaaaccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggaaaaaaaaaaaa

SEQ ID NO: 72 - DNA, 5824 bp, Homo sapiens
  CDS (590)..(5824)
ttcgagatccctagtcagtgtggtggaattcctttacaccagacaggcctcattttaaatcctgtctctaccgtttactagctgtgtgatcttgggcaagatacttaacctctctgagtttctgtttcctcatctatcaatgaagatgatactatgaacccaataaggctgttaaaacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtag

SEQ ID NO: 73 - DNA, 2254 bp, Homo sapiens
  CDS (186)..(2159)
  misc_feature (1)...(2254): n = a,t,c or g
cgcgaaaantttgatttgatcgcctgcggtaccggtccggaattcccgggtcgacccacgcgtccgggctggactgcttatttggggtagccctgaagccagaatcttcagatcttttcttttgtgtcagttatgttcctcagaaatggtttttcattctcctgcctggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgactttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttcaccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgacatcattgctcagctcccaccacccattaaaaagaagaaatttggaacctaaaacagggcactgtctgtgtccttccttgaactgtctaccctgttgcttttcacaaatcatggtaataaaacaagttattcttgaaaaaaaaaaaa

SEQ ID NO: 74 - DNA, 3718 bp, Homo sapiens
  CDS (90)..(3122)
caccggtccggaattcccgggtcgacgatttcgtcctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccggtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaagagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagagaaaaaaaaaaaa

SEQ ID NO: 75 - DNA, 13857 bp, Homo sapiens
  CDS (1)..(13857)
atgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggcaccaacagtggtgggcttggaggggaatgggggggctgcgggacactgaccgatttccctccgttctctttccagcaccaggccactacagttacccggaggtgcgccccccagccccgccccccaagtcccggccccggccagccccagccccgcggcccccacggcccccttggccctcgaggccagcagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcgtctgttggccgccgccccagccggctcccccgcacccccgccccgccacccccgccccaccgccagccctgatcccggcaccaggaaacgggactccaaccagggaatctacggcctctcgcctgaaggcgtcgaccgggtggctgcgtcccgccaccccaagccagaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactggtgtgacatcccgtcgaaaccccaagccccagtcccaggctgccagttcagcacctggctggatctccttgtttacagctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagggacccacactgggctctgtgaggccctgtgcctggtccctgggatgaggccctttaggaaagaaatgggcatcagtgcgcattatcagagcagcaaaaggacgaagcagctggagtccgccaagctgggggctgtgtctggcagcacacacagtgcagttgccagggggagagcctcagacaccgagcagggacctagtgaaggactgttgaccagacagatgttcagatcaatgcgcttttacatcaaaaccatcatgcgggttccacaaatgcaacagacatcgctggccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggcccgggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagctccagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacacggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctga

SEQ ID NO: 76 - DNA, 1376 bp, Homo sapiens
  CDS (61)..(1335)
ctgcaggtaccggtccggaattcccgggtcgacgatttcgtggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcagaagcggccgctctagaggatccaagcttacgtacgcgtgcatgcgacgtcgaccag

SEQ ID NO: 77 - DNA, 1923 bp, Homo sapiens
  CDS (112)..(1233)
cccggccccaaccttatctgatgctgtgcattagacagcacactgctgactgttttcagttgtttctgtaacagcagaaagtgcactcactaggagtagtcagaattcaaaatgctgaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcataaaaaaaaaaaa

SEQ ID NO: 78 - DNA, 2179 bp, Homo sapiens
  CDS (284)..(1957)
ccggaattcccgggtcgacccacgcgtccgcagcgactaaggcggcagaggagcggcggtggtggcggcgctgcagcagcgggcgggactgggatggtggttccacagggcagaccccgctgcactcacagggaggaggaggcggcagcggcggaggaaggcggcgcaccccgagaggtggattgtctcattgttagtgctgaatcttcttgcctacttgtatctgggaatttaactttgaagaggaagagagtgaatatgaataactgaaaaataaaatggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttggtaatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtctggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgagagccaggtgctagcaacagacaaattctgagcccaatatgctttatactgctagacagggattggtgtgtttg

SEQ ID NO: 79 - DNA, 2072 bp, Homo sapiens
  CDS (46)..(1686)
tgccgtaccggtccggaattcccgggtcgacgatttcgtctcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacgaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaacgacaaccaccccacgtggaaggacgcaccctactacatcaacctggtggagatgacccctccagactctgacgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtgctgccccggcctccacccacctgtgcaggcctcctggggccctgcctccacccctcccagatggacagccagactaggtgggggcaggtgagggtggaaaagaggtcagggctctactgttgggctttagcctctggtggtgcctcccgaggatttgctcctggctcttcccaagggctttgcagctggatcactctggactggctccctggggacctcctgaacctgttggttgcagggacggggagcatctaccaaggttcattctagagggaggtaaggccccatgattcctagggaggagccctgagccccactccccgccccaagtctgggtgacagagcagtgacttggaggaatgtggcctcatccttccttggggacctgttgagaattcccacctgtttagaggcagatggttttgatctccctaaatgaaatggttttagctcaaaaaaaaaa

SEQ ID NO: 80 - DNA, 2534 bp, Homo sapiens
  CDS (399)..(2534)
cggccgctggggctgctgttaccgccgagccgggcgccgcagcggctcctcctggggcctacatttgccccgccagcccgtgtccggagcccccttcgcgggttacataaccaggctcccggccgagtgggcgaagcccagcacatttcgggggcggggggcaggtgagggtccccagatgtcccttcagtgcttccgaagacaccggaggggagtaccccgcgtagagcgcagctggaccctcggggtgcgggcccctctccttgtcctgcttttcagcatctttggcaattgcgcaaagttgcttgggttgcaatggtggggtgcagggggcgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaaggtgagtggcccagtggggacaggtggtgctgacgctctggggcaggtagggttgctggagatgctggtgagatggtgggatgcaggtcgtgcagtgaattcctggaggacccctgagtctgggtga

SEQ ID NO: 81 - DNA, 4100 bp, Homo sapiens
  CDS (105)..(4100)
atacagttgatacttatgacagtggcgatgattgggaaaatcggggttgaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaaaaaaaaaaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaacaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagttccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggtacgtgttgtcggttctga

SEQ ID NO: 82 - DNA, 2300 bp, Homo sapiens
  CDS (514)..(1419)
gtggaattaccgaccgcatcggaattcccgggtcgacgatttcgtgccggaagagaccggaccctgaacagaatcgcatattgccagcccttttcccgacccctacggaaagacgagtccaggggccgtcctggcgagttcaaaacatttagtctggtcttttcaggtgaggacttccccatccaggcacagtgccggtccaatccccctttaatttcccatgactcctcgcgtcctgaagccccgcccccagttccccagccccgccccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacgcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccttcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgcaaaaaaaaaaaaaaa

SEQ ID NO: 83 - DNA, 2463 bp, Homo sapiens
  CDS (92)..(892)
gaaattccgggcgaccccgcgtccgcccacgcgtccggaactgaggacagggacagaggttatattatggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacatagctttaatacagctcttctgttgacagttattactttaattttgcatttgttccttgtaagaatggctggaaactgtgtgttgacatttgaggatgggtatgcaaggaaaaaatatacttctgtttacttactctgaaaaaaaaaaaaaaa

SEQ ID NO: 84 - DNA, 2074 bp, Homo sapiens
  CDS (198)..(1778)
aggatgagattgtaagcgtacgcctgcggtaccggcccggaattcccgggtcgacgatttcgtctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacctccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaaaaaaaa

SEQ ID NO: 85 - DNA, 1550 bp, Homo sapiens
  CDS (46)..(1437)
ttgcacgaccggtccggaattcccgggtcgaaacgtttcatctaaatggtgtgcaagcggaagggggccggtgttcttttctgcaccccctgcaagcagccgctctgccctccgccctcttctcccacctgcgaaggtgcccccaccgaagctggcggggacgctgtccgagccgggggcaccgcccccttgtccgaccagcagcagcatgaatgtggcgactcggactgtcgggagtcccccgaaaacccctgcgactgtcacagggagccgccccccgaaaccccagacatcaaccagctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacagctggtgcagcagtacccccacatcaccttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactggcacctgtctgtgtgtgttc

SEQ ID NO: 86 - DNA, 3215 bp, Homo sapiens
  CDS (264)..(3128)
ggtccggaattgccgggtcgacccacgcgtccgctggcgaactccaagcgcttgaatacctgtgacgtaaccgcccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaaaaaaaaaaaaa

SEQ ID NO: 87 - DNA, 879 bp, Homo sapiens
  CDS (366)..(827)
caaccacccagaggtgaggagatagtagaggaagaaggagaaggggggtggggggcgcgaagcacaaagagcaaaggcaaaggcaagcacagtgacagatgagacttgagaggtgccaggggccagggtatgcgaggccttggaggccagcatgcagtctaggatgaggcctcctaccttcagcctgcctgagggccaggagctggagggaggcgagtgaaggcccttcttcccgtgcctgcagtaatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggtcacaggggcgggaccgaccccgcagaagacaactacctgtagccaccgcccctgcggacggcgtgggttcagcagcccacctctgagtctcacg

SEQ ID NO: 88 - DNA, 4334 bp, Homo sapiens
  CDS (64)..(3810)
aggtgacactataaaacaagtctgtacaaaaaagcaggctggtaccggtccggaattcccgggatgaaggagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctatatctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctcaaaaaaaaaaaaa

SEQ ID NO: 89 - DNA, 2108 bp, Homo sapiens
  CDS (167)..(1903)
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagaattaaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaaaaaaaaaaaaaa

SEQ ID NO: 90 - DNA, 2498 bp, Homo sapiens
  CDS (530)..(2356)
gcaggtaccgcgtccggaattcccgggtcgacgatttcgtgtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaaccattttacgtgtgtagcatgtcaccccacggaagaccgcatcgcatctggtcacatggatggccaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaaaaaaaaa

SEQ ID NO: 91 - DNA, 1024 bp, Homo sapiens
  CDS (216)..(698)
cgatacgactcactatagggaatttggccctcgaggcaagaattcggcacgaggctaaaggatcccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgagtcaaaatcctagaccctgatggtgtgctggcggagccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggaaaaaaaaaaaaa

SEQ ID NO: 92 - DNA, 2818 bp, Homo sapiens
  CDS (449)..(2818)
aaggatccttaattaaattaatcccccccccccccctggctcgtctgaacttgaagacaccccacattccaagatgcccgaggttcctgggaatgcctggggttcttcgatccggaaaatcctaccggcatcctcctagggagggattattattattatttttctttaatctggaagagaagagaacaagttgtgcttttccccccttcttcttgctaaatgccatggatataactgaataagcggctcagggctttccccgcgtggacgtccgaggccaccatctgcctgcattcgccggagccgccggagggtttagctcgagtctgtctcgggcggggaaggatgcgtggccgagccggggagcccgggcgccccgcggagccggcctcggtgccacccagccgggggtagatgctgcctcgcccaggcgctgagtgaccagaccatggagaccctgcttggtggcctgctagcgtttggcatggcgtttgccgtggtcgacgcctgccccaagtactgtgtctgccagaatctgtctgagtcactggggaccctgtgcccctccaaggggctgctctttgtaccccctgatattgaccggcggacagtggagctgcgcctgggcggcaacttcatcatccacatcagccgccaggactttgccaacatgacggggctggtggacctgaccctgtccaggaacaccatcagccacatccagcccttttcctttctggacctcgagagcctccgctccctgcatcttgacagcaatcggctgccaagccttggggaggacaccctccggggcctggtcaacctgcagcaccttatcgtgaacaacaaccagctgggcggcatcgcagatgaggcttttgaggacttcctgctgacattggaggatctggacctctcctacaacaacctccatggcctgccgtgggactccgtgcgacgcatggtcaacctccaccagctgagcctggaccacaacctgctggatcacatcgccgagggcacctttgcagacctgcagaaactggcccgcctggatctcacctccaatcggctgcagaagctgccccctgatcccatctttgcccgctcccaggcttcggctttgacagccacaccctttgccccacccttgtcctttagttttgggggtaacccacttcactgcaattgtgagcttctctggctgcggaggctcgagcgggacgatgacctggaaacctgtggctccccagggggcctcaagggtcgctacttctggcatgtgcgtgaggaggagtttgtgtgcgagccgcctctcatcacccagcacacacacaagttgctggttctggagggccaggcggccacactcaagtgcaaagccattggggaccccagcccccttatccactgggtagcccccgatgaccgcctggtagggaactcctcaaggaccgctgtctatgacaatggcaccccggacatcttcatcaccacatctcaggacagtggtgccttcacctgcattgctgccaatgctgccggagaggccacggccatggtggaggtctccatcgtccagctgccacacctcagcaacagcaccagccgcactgcaccccccaagtcccgcctctcagacatcactggctccagcaagaccagccggggaggtggaggcagtgggggcggagagcctcccaaaagccccccggaacgggctgtgcttgtgtctgaagtgaccaccacctcggccctggtcaagtggtctgtcagcaagtcagcaccccgggtgaagatgtaccagctgcagtacaactgctctgacgatgaggtactgatttacaggatgatcccagcctccaacaaggccttcgtggtcaacaacctggtgtcagggactggctacgacttgtgtgtgctggccatgtgggatgacacagccacgacactcacggccaccaacatcgtgggctgcgcccagttcttcaccaaggctgactacccgcagtgccagtccatgcacagccagattctgggcggcaccatgatcctggtcatcgggggcatcatcgtggccacgctgctggtcttcatcgtcatcctcatggtgcgctacaaggtctgcaaccacgaggcccccagcaagatggcagcggccgtgagcaatgtgtactcgcagaccaacggcgcccagccaccgcctccaagcagcgcaccagccggggccccgccgcagggcccgccgaaggtggtggtgcgcaacgagctcctggacttcaccgccagcctggcccgcgccagtgactcctcttcctccagctccctgggcagtggggaggctgcggggctgggacgggccccctggaggatcccaccctccgccccgcgccccaagcccagccttgaccgcctgatgggggccttcgcctccctggacctcaagagtcagagaaaggaggagctgctggactccaggactccagccgggagaggggctgggacgtcggcccggggccaccactcggaccgagagccactgctggggccccctgcggcccgggccaggagcctgctccccttgccgttggagggcaaggccaaacgcagccactccttcgacatgggggactttgctgctgcggcggcgggaggggtcgtgccgggcggctacagtcctcctcggaaggtctcgaacatctggacgaagcgcagcctctctgtcaacggcatgctcttgccctttgaggagagtgacctggtgggggcccgggggacttttggcagctccgaatgggtgatggagagcacggtctag

SEQ ID NO: 93 - DNA, 3626 bp, Homo sapiens
  CDS (296)..(3325)
gtgaaaaatttattgctgtacgcctgcaggaccggtccggaattcccgggtcgacgatttcgtggagggggcgcgcgtcgcgcagatcgtcgcggagccacggcaggaggaggcaggggccgcgggcgagcctgcgctgggccggccgagggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcacctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcgtttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccgggtcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatgtgaaaaaaaaaaaa

SEQ ID NO: 94 - DNA, 1897 bp, Homo sapiens
  CDS (527)..(1897)
cggaattcccgggtcgacccacgcgtccgcacagtccccactgatgctaacctctgtgtttggaaatactctttgtctggagacacttctgtgggctacttcttttttcaggcagaactcaaccttggtgtgttatctgaccaacttcccacatacgctgaagagaagtgcacatggccatcaaaggcacgcgccccccccttcccttcagctgccttggcagctgccgaacccaccctcgcagtggctgcccagaacctttacacatgtatgtgtgcgcgtgtgcagagcatgacaaggcaggtggctggggctccagcctggctaaagagaacttgcccttaggggcaagagagggaggcactgcatttccagtttcgttctggaagtgcccacctgacatctgtggtgcccactgatctttacagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtga

SEQ ID NO: 95 - DNA, 2894 bp, Homo sapiens
  CDS (372)..(2894)
atttggccctcgaggccaagaattcggcacgagctggcttgtctggagccagcctgtagggttggggagcctttctctccatagttccagggtttggtgaagcatcttacaccagtaagtattgattgaacgtctgtcagtgacctctgcaaactctgcttttgttgtaggaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttggccaaaggggcaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatggctgttaa

SEQ ID NO: 96 - DNA, 1522 bp, Homo sapiens
  CDS (158)..(1303)
atttggccctcgaggccaaaaattcggcacgagggattatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaaatgtttattccaaaacagctttaatggcccatatgtacaccttcgtaatcttcaaggtta

SEQ ID NO: 97 - DNA, 1202 bp, Homo sapiens
  CDS (155)..(976)
atttggccctcgaggccaagaattcggcacgagaactggaagagcaggtgaagaggctccttgggtgggcacccctggcgtcctcccatgagggcagcctcacaggggtgtctgcctgtgagttttgttacagggcctcaccaagagagggcctatggaggccgaggaccagggggagcttttcctgcacctccggtcagtggcacgtgccccccagaccttatctatgcaccgactccagagaaagctgaaggaggcagccagaaaaatcatcagcctccgcctggagaaagagcagctcatcgagatggggaacaggctccgtgcagagctgggccgacccgaaaggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagagctcccagctcctccagcagccgacaggaggcccgtcaagatgcaggcaggcattgccaccccagggatgaagacagcagcccaggcaaaggccaagaccacaggagcctcccggtctcatcctgcaaaagctaaaggctgccagaggccccccaagatccgtaactacaacattatggactgacttcctccccccaccccgccccactaaggggtgctcggggcctccgcatggtgcctgtgctttcacctacgtgttgtgggggggtgtgggcacagcgtgcagggtggaggcagggagctgcagggcaggctcccaaatgctgctgaggcgaccctgctgactgaaggcctccctgagcacagggcccattaaaaccaggttcctccctggggaaaaaaaaaaaaaa

SEQ ID NO: 98 - DNA, 6314 bp, Homo sapiens
  CDS (1)..(5379)
atggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcattaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactctgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaattcttgctccagagattggcatgcaggagattgcattgcattcaggtgaagaaccacatgctgaggaacacctgaaaggtgacttttacgaaagtgaacatggtataaatatagaccttaatataaatagtcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaataatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacaatagcagccttgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagatcctcatttaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagttgagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaatttaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccaagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgaaaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttatttaaaaaaaaaaaaaa

SEQ ID NO: 99 - DNA, 1606 bp, Homo sapiens
  CDS (103)..(1071)
atttggccctcgaggccaagaattcggcacgagggcagctgcagggtctcgctgggggccgctcgggaccaattttgaagaggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcataaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacaaaaaaaaaaaaaaaaaattgcggccgctctagagtatccctcaaagaggcccaagcttacgcgtacccagctttcttgtacaaagtggtgccgatatgtgagacgaatgatggctagatcgacgatcgc

SEQ ID NO: 100 - DNA, 2275 bp, Homo sapiens
  CDS (770)..(2230)
ccactttgtacaagaaagctgggtacgcgtaagcttgggcccctctagggatactctagagcggccgccctttttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgcgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcgttggaatcctcatcctggtcctcattgtagccacagccattcttgtgacagtctatatgtatcaccaccatgtattgcggccgctctagaggatccaagcttacgtacgcgtgcatgcgccgacggtgcttcat

SEQ ID NO: 101 - DNA, 2817 bp, Homo sapiens
  CDS (770)..(2359)
ccactttgtacaagaaagctgggtacgcgtaagcttgggcccctctagggatactctagagcggccgccctttttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgcgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccataggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgaaaaaaaaaaaaaaaaagggcggccgctctagagtatccctcgaggggcccaagcttacgcgtacccagctttcttgtacaaagtgg

SEQ ID NO: 102 - DNA, 1156 bp, Homo sapiens
  CDS (251)..(904)
taatgctgtacgcctgcacgtaccggtccggaattcccgggtcgacgatttcgtacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaaaaaaaaaaaaaaaaaacctatgcggccgcaagcttattccctttagtgaggttatactaaaaccg

SEQ ID NO: 103 - DNA, 3227 bp, Homo sapiens
  CDS (440)..(1747)
atttggccctcgaggccaagaattcggcacgagatggcatctccactctgtgacccagactgccacttggccccaaaagaatatttcttctgacagtggacagctgacatatcaccactttccttctactgtgagtgtctctggatgggcagaaaggaatggccagcccctggttatggtcatctaaggtcacctctgaaatgctgtgagcccctcttccttcctctcctctgctatttcccatctctgctgttggcaggagaatagaaccctggctgccagagatgcaagtgtgtgacgatatgggtgctggtgcatatttagtatgtgcctgtgtccagccatgtgcatgtgtgggtgtgtgagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttcccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattggattttattttgcataatcatgcccttcactgacagtctccttaacatcatctgtttactctgctcagtggaaactacaatgctctgtcatctccctactgggtctcctgggaggagggg

SEQ ID NO: 104 - DNA, 7827 bp, Homo sapiens
  CDS (121)..(7497)
ccattcccaagctggctagcgtatagatttccgtttggtaccgagctcggatccactagtccagtgtggtggaattcgagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaaaaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaaaaaaaaa

SEQ ID NO: 105 - DNA, 3304 bp, Homo sapiens
  CDS (55)..(2406)
cttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaa

SEQ ID NO: 106 - DNA, 3757 bp, Homo sapiens
  CDS (83)..(2284)
ttgaatcgtacgcctgcacgaccggtccggaattcccgggtcgacccacgcgtccggcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagaatcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccagcagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaagtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggtgtggtagtgcgtgcctgtgatcccagctacttgggaggctgaggtagaagaattgtttgaacctgggaggtggaggttgcagtgagccaagatcgtgccattgcactccagcctaggcaacaagagtgaaactccatctcaaaaaaaaaaa

SEQ ID NO: 107 - DNA, 2783 bp, Homo sapiens
  CDS (84)..(1448)
atctcagagtggcggaattcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaagggttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaaaaaaaaaa

SEQ ID NO: 108 - DNA, 2265 bp, Homo sapiens
  CDS (79)..(1614)
taagcttgcgaccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcaaaaaaaaaaaaaaaaaagggcggccgctctagagtatccctcgaggggcccaagcttacgcgtacccagctttcttgtacaaagtggtccctatagtgagtcgtatataagctaggcagtttcatccagcagtcaaccctcatccttgg

SEQ ID NO: 109 - DNA, 2349 bp, Homo sapiens
  CDS (79)..(1698)
taagcttgcgaccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaaggtaagacggtgtgtgctgcccgcggcccggcccccgtctcctgtgctgcccacagctgacctgggcctgtctctcctgtttcagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcaaaaaaaaaaaaaaaaaagggcggccgctctagagtatccctcgaggggcccaagcttacgcgtacccagctttcttgtacaaagtggtccctatagtgagtcgtatataagctaggcagtttcatccagcagtcaaccctcatccttgg

SEQ ID NO: 110 - DNA, 6674 bp, Homo sapiens
  CDS (1312)..(6330)
  misc_feature (1)...(6674): n = a,t,c or g
ccactttgtacaagaaagctgggtacgcgtaagcttgggcccctcgagggatactctagagcggccgcccttcttttttttttttcccaaaggtcctgtgcctataacaattccaggtgggccaggaggacctgcttcacccttttctccctgcgggccctggcggcctatgagtcctgggtacccgggttcaccaggaaaaccgggactccctttttcccctttgtcaccatcttttccgggtttgcctctgggtcctggttttccgggttcacctttctctccgacccctggcatcccctgaaatccaggttcacctttttggcccttttctcccttggtggcgaagtctcctttttcttgaacttgagcttgtcctggtactcctggaggcccactgaccccttggtcacccttgtcaccttttggtccttgaaaacttaagcccatttgtcccttttcacctggagggccnggagggcctgggggaccntgtggtccggtaaatcctggaggcccaacaggaccttgaagccctggcagtcctggtgggcctggagtccctgggattccgggaaatcctctttcacctttcaacagcatcccgggcacatggccaagtatctcacctggatcacccttaccatcatcaggcttcaccatctcaccttggaagcgttcaatcttttggtcaatatttctgcaccacagcatccaggtgcacgctctgtgggatccctgcccgttggtggcctgacctacagaccctttgctgaaggaccctttgctgaaggctcctggcctgtggccatcaccggacagaccctttgctgaaggctcctggcctgtggccaccactgtcatacagcgctgttccttgggctggagggagagcttttgccacctcatctcccatccgccaagacgctctgggcgaggaaccccacggtcactgtccccagcagcagccaccgccgtagggcagggccggccaccgcgcgctggtctctccccatgctggcggttcgtccactctgggccccggtcagtcccacttagcctcgggctcggcttcaggggctgctgcccgaacgcattggcccttccagaagcacccgccggcggcacaccggcagggcggccggccttgctgggctctctgggcgccggccccgggggctcgggcggcccctttcggtcctcggcccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattacagggcagccaggatttataggcgaaattggagagaaaggacaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccgtcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggctcgccgggttctgtaggaaaaattgttcctttaccaggcccccctggagcagaaggactgccggggtccccaggcttcccaggtccccaaggagaccgaggctttcccggaaccgcaggagggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccaggactgcgtggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaaaaaaaaaaaaaaaagggcggccgctctagagtatccctcgaggggcccaagcttacgcgtacccagctttcttgtacaaagtgg

SEQ ID NO: 111 - DNA, 1421 bp, Homo sapiens
  CDS (217)..(1230)
ataaattagaacgcctgtggtaccgctccggaattcccgggtcgacccacgcgtccggagggagtggagaacgcataagcaagctggtttgaccagaaacagaactgcctgtgacagattaagagacaagcaaggcttggaatctgagagcaagcaaagagagtggaaatttacagctgccctatcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatataaaaaaaaaaaa

SEQ ID NO: 112 - DNA, 2416 bp, Homo sapiens
  CDS (59)..(952)
ccggaattcccgggtcgacccacgcgtccgcggacgcgtgggctgggagctgtggtgcatgtacatcagccccccaaaagactggtggtacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccaaaaaaaaaaaa

SEQ ID NO: 113 - DNA, 1007 bp, Homo sapiens
  CDS (58)..(786)
atttggccctcgaggccaagaattcggcacgagcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggg

SEQ ID NO: 114 - DNA, 3074 bp, Homo sapiens
  CDS (366)..(2213)
ccggaattcccgggtcgacgatttcgtggacacctggcaagtcctgccctgcctgtcccccaaccttggtcggcccgcccgcgcacggctggcctccctaggccacattcttgcacaaagttcgagaggctgtgggaaaagcaaccctgaaccggccaagggccggcgaagctgatcccgcaatggcattttgttttgaacagttgctggggttgacgtttcctcataagaggggtactggacaccagcgcagagtgcagactgaatggggaaaggagatgcagagaaaatctggcaacatacctattcttcacatcctactcgtgggggagggctgctagtggccctctgcaccaacccaaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccagcaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaatagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggcctgccagcagcgagccacacattaagcgaccatatgaatgcattcataggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttaaaaaaaaaaaaaa

SEQ ID NO: 115 - DNA, 3442 bp, Homo sapiens
  CDS (145)..(3078)
gctaccggtccggaattcccgggtcgacgatttcgtctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctctcccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaaaaaaaaaaa

SEQ ID NO: 116 - DNA, 3376 bp, Homo sapiens
  CDS (145)..(3012)
gctaccggtccggaattcccgggtcgacgatttcgtctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctctcccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaaaaaaaaaaaa

SEQ ID NO: 117 - DNA, 2616 bp, Homo sapiens
  CDS (261)..(2159)
caccggcccggaattcccgggtcgacgatttcgtgtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaggtctttccaaggttgtaccacctgattccagatggtgaaattaccagcatcaagatcaatcgagtagatcccagtgaaagcctctctattatgctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaaaaaaaaaaaa

SEQ ID NO: 118 - DNA, 1431 bp, Homo sapiens
  CDS (481)..(969)
tttgatagctgtacgcctgcaggtaccggtccggaattcccgggtcgacgatttcgtggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactaaaaaaaaaaaa

SEQ ID NO: 119 - DNA, 2236 bp, Homo sapiens
  CDS (80)..(1369)
ccgtccggaattcccgggacgagccacgcgtccgcagacatggccgggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaaaaaaaaaaa

SEQ ID NO: 120 - DNA, 2507 bp, Homo sapiens
  CDS (256)..(2091)
catgcagtacgcgtgccggaactgccgcggagatcccggctcgacccacgcgtccgcggacgcgtgggtcgcccacgcgtccggcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaaaaaaaaaaa

SEQ ID NO: 121 - DNA, 4771 bp, Homo sapiens
  CDS (3023)..(4771)
atggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtggaagttttactgccaaatagtactctatctgacagatttgttattgaagtggacattattccacagttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagattttaaaacactggcagagtccagaaaagcagcagaagaaaaattcagagcaaaaacaaataaaaaagaaagagagggaccaaagttggttaaattattgacaggaaatcaagatttgttagataattcatactatgaacagtacattcttgtaacaaataaatgccacccagatcaaacaaaacacttagatttcctgaaggaaattaaatggtttgctgtattggagtttgatcctgagtctaacatcaatggagtggtcaaagcttacaaagaaagccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgatccaagttcctggcaaagagaaagagcttctgatgtcaggaaactgatttcatttcttacacatgaagacataatgccaagagggaagtttttggtggtatttctattactgtcctctgtggatgacccaagagatcccctcattgagactttctgtgctttctaccaggatctcaaaggaatggaaaatatactgtgtatttgtgtgcacccacacatatttcagggatggaaagatctacttgaagcaagattaataaaacaccaagatgaaatttcaagccaatgtatttctgctttaagccttgaagagatcaatggcactattcttaaactaaaatctgtgactcaatcttcaaaaaggcttttgccatctattggtttatcgactgtccttctgaaaaaggaagaagatatcatgactgctctggaaattatctgtgaaaatgaatgtgagggtacactgttagagaaggacaaaaataaattccttgaattcaaggcatcaaaagaggaagacttctatcgaggtggcaaagtgtcatggtggaacttctacttctcttctgaaagttattcttcaccttttgtcaaaagggataaatatgaaagacttgaagcaatgattcaaaactgtgcagattcttctaaaccaacaagtaccaaaattattcatctgtatcatcatccaggctgtgggggaactaccttggctatgcacattctctgggaactaaggaagaaattcagatgtgctgtgctgaaaaacaagacagtggatttttctgaaattggagaacaggtaaccagtttaatcacctatggggcaatgaaccgtcaggaatacgtacctgtactactccttgttgatgattttgaagaacaagataatgtctatcttctgcagtactctattcaaacagctatagctaaaaagtacattcgatatgaaaaacctctggtgattatcctaaattgtatgagatcacaaaatcctgaaaaaagtgcaaggatcccagacagtattgccgtaatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctgataccaccatttcactatcacagtgtgaaaaattcttaggaattggaaacaagaaggctttctgggggacagaaaaatttgaagacaagatgggcacctactctacaattcctgataaaaacagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggcaaaacaagcaaaaatcatagaacctgacaattcttatatctcagatacactgggtcaagtctacaaaagtaaaataagatggtggatagaggaaaacggaggaaacgggaacatttcagttgatgatctaattgctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaaacaattgtttatatatagaatatggaatcaatgaaaaaatcacaatacccatcactcccgcttttttaggtcaacttagaagtggcagaagcatagagaaggtgtctttttacctgggattttccattggaggcccacttgcttatgacattgaaattgtttaa

SEQ ID NO: 122 - DNA, 1470 bp, Homo sapiens
  CDS (141)..(869)
ttttgagcacgctgtaccggtccggaattcccgggtcgacccacgcgtccgcccacgcgtccgctttagccagagaactgggtgcatctgagccagtggagatttgtgacttctccttcttctaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcgtgggtgctgggcctgccttctctggctgcttgctgcctgtctgctttccttggtggctttggcttctgcactccttggcgtcagcctctcaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaaaaaaaaaaaa

SEQ ID NO: 123 - DNA, 1650 bp, Homo sapiens
  CDS (88)..(1005)
ccgccgagctcgctgtggcccggatgttcggtgcagctgccagatccgctgatctagcgcttctcgaaaaaaaccttcaggcggcccatggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaaaaaaaaaa

SEQ ID NO: 124 - DNA, 1534 bp, Homo sapiens
  CDS (138)..(1334)
ggaattctttctgtcttgccttgcagttataagttttaaaggttttatttttgtcttctgctttaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtggttgctgtaagactttgtacatttttgtgcatattggtatcatttggcagtagggctggaaccaaagtattactctt

SEQ ID NO: 125 - DNA, 2850 bp, Homo sapiens
  CDS (635)..(2422)
cgggtcgacgatttcgtactatacctaatctgcctggaactaaatccagatctaggctctacttttatttattccattcttgcaatgattgaatgaccttctcttttgtaaaaaattgagctatagtttacataccatcaaattcacccttttgatgtatacaactcaggggtgattagtatattcacaaaaggtgtgctagcatcaccactgtctcattttggagcattttcatgcccccaccatgaagaccatgtccactggcagccattcccatgacctttccttgtgagatctccagttatcactttgcacaagctgatgaattgctgttcttgataatactgagctttcacaatcacagttgccagagaaacatcagcgggctttagctggggcagagcttagcaagtgttggggtatcagcagttagtcactgtttgcctggaaccacaggatgtgaatcctagttcctggattccaaggaatcctgcatccaggtgtttattgtgctttgcagagtcaacatcaagctcaggagctggttgcagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcaaaaaaaaaaaaaaaa

SEQ ID NO: 126 - DNA, 3423 bp, Homo sapiens
  CDS (53)..(2800)
gcacgaggtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggttcaattagcagaatttctagaaaatttacaagaaaagtccttgaggattgaagcctttgttagtgagatagaatccttttttaataccattgaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgacttcgtttgaggaaatcaatgaaaggttgctttctgcaatggagagcactgcttctttagagaaaatgcctgctgcgttttcccttttcgaacattatgatgacagctcggcaagaagtgaccagatgttaaaacaagtggctgttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaaagtgctatatattagaaatttccattttgttaaataaatggttagagtctataaagccaaaaaaaaaaaaaa

SEQ ID NO: 127 - DNA, 1668 bp, Homo sapiens
  CDS (1)..(1668)
atggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactga

SEQ ID NO: 128 - DNA, 3964 bp, Homo sapiens
  CDS (174)..(2540)
actgttggaggtgacctatagaacaagtttgtacaaaaaagcaggctggtaccggtccggaattcccgggatggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaagatgacatgtttttatatatatttggaattgttaaattggttttgctgaaacatttcacccttgagatattatttgaatgttggtttcaataaaggttcttgaaattgttaaaaaaaaaaaaa

SEQ ID NO: 129 - DNA, 2905 bp, Homo sapiens
  CDS (87)..(2216)
gccacagagacggtgtcagtggtagcctagagaggccgctaacagacaggagccgaacgggggctttcgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacaaaaaaaaaaaa

SEQ ID NO: 130 - DNA, 8503 bp, Homo sapiens
  CDS (91)..(8082)
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattcttcagaattccttgggaggaaatccaaagacacgtattatctgcacaattactccagtatcttttgatgaaactcttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaaaaaaaaatggaattgaaattaaaagaaaagaatgatttggatgaatttgaggctctagaaagaaaaactaaaaaagatcaagagatgcaactaattcatgaaatttcgaacttaaagaatttagttaagcatcgagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaacttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcaagaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgagccaaactatctatgcaagtgtgagatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaaaaaaattgtaaatgtttttaataccttacacattcaataaatgtttagtagttctgaaaaaaaaaaaa

SEQ ID NO: 131 - DNA, 1693 bp, Homo sapiens
  CDS (88)..(1512)
atttgaacgcttgaggtcccggtccggaattcccgggtcgacccacgcgtccgcggacgcgtgggattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccactggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacggtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggttttaggtcttgcatatcagttttattactgcaccatgtttacttcaaaaagacaaaaaaaaaa

SEQ ID NO: 132 - DNA, 920 bp, Homo sapiens
  CDS (171)..(737)
tgagttatgtgattggagaccatggaacgcctgcggtaccggtccggaattcccgggtcgacccacgcgtccggactagttctagatcgcgagccgccgcccaggaaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcacatccccctccggctgcgcacactgcatgcctgggaaaggccagcacttcatggaccctggggaggccccgccccctccccacacccctgctccccactgccgctgctgcctcaataaatctgctgatttgcaaaaaaaaaaaa

SEQ ID NO: 133 - DNA, 1005 bp, Homo sapiens
  CDS (276)..(584)
ttcggtaccgctccggaattcccgggtcgacccacgcgtccgcagaaatctccaggccaccggctttccgctaccggattggctgcgtccgggtgctgaggcccggcccatttccccgggtcctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaaaaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatttgcttcccctgctgtcacctggctccccctgctgggtgctgggtttccatttttccctccacccaccctcaacagcatttgctttccatgccctcaccatcacctcactgcccccaggccttttgccctttgtgggtgttgagctccccgcccccccccaggcactcataggaaaaggctttccttttgggatggcggcggctggtaaacccctttgctttttctagccctcctgggctgggcttgggcccaaatccccaggcaggctttggagttgtttccatggtgatggggccagatgtatagtattcagtatatattttgtaaataaaatgttttgtggctaggaaaaaaaaaaa

SEQ ID NO: 134 - DNA, 4323 bp, Homo sapiens
  CDS (81)..(3920)
tccaggctctgcgtgataagctgtggatcttcctggttcagtctttctatgctgttcgtcacacagaaagctggaagctgatgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaaaaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtagtaatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaaataaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcgcctcaaggcgagtggacaattctggaactggaaactcagcattaagtgttaacattttggaaaaatttatgccactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtccaaaaaaaaaaa

SEQ ID NO: 135 - DNA, 6320 bp, Homo sapiens
  CDS (237)..(5549)
taagcttgcggccgccggcctcctaggagcgctgcacctggtgatgaccctcgtagtggctgcggcgcggcgccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggtccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacggtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaaa

SEQ ID NO: 136 - DNA, 1085 bp, Homo sapiens
  CDS (250)..(1059)
cccggtgatgtatatatctatctattcgatgatgaagataccccaccaaacccaaaaaaagagatctctcgaggatccgaattcgcggccgcgtcgacctttatctgaatctattgaattgagacgatcatgtgatttttggccttcattctattgatgtaacgtataacgtttagtaatttgcataatttgaactatctttgcattcctgggataaatcccacttgactgtgggatattattgatttgatgtgttgctggatttggtttgcaggcattttgtgcaaaaattttgcgaggcggcatgaggacctgcggcaggccctcttcggcagtctctctggcccgggttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagcaagtatctcttaacgtttttacagacaatagaataggtg

SEQ ID NO: 137 - DNA, 809 bp, Homo sapiens
  CDS (252)..(809)
atttggccctcgaggccaagaattcggcacgagccacggtccaggctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtga

SEQ ID NO: 138 - DNA, 5314 bp, Homo sapiens
  CDS (531)..(4376)
aattttgaagccggtcgcctgccctaccggtccggaattcccgggtcgacgatttcgtggttgttgtagtaaccggggaagcagccgtcggcggctgccctgagccttcctggggaaggaggagggaggtaggcgcagagcgcggtccacgcctgctcgccccgaaccatgggaagatgagacaggtaaacgcctgcgcccgcgcgcttccctaccctagggaggagcattcccgggtccgggctggcgcctgcagcaggacttcccgctcagagcccgggagtagctgttggcttccgggcgcgccgcgttgaatcgcggctgcggggtcgtcccgtccttcccggggggagcatctgcggacctacgtgggattggggtgagctgggggtggggctgagaagcaaattcctttcgggagaggagtctccttaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggtttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccaccttcgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctatttttattttcttttttttccctttactaatttcccaacaatcaatattcacaaacaggactgaagtagaaccagttttttattttactttgtggctgtgcaattttttaaacattttagaaatgtgagctgtaaagagatgttttatttttacatttcatttcagcagatggtgggtccaggctattcccaaaggcagctcctgcacctggggagcgggcatgtgcagatgtctccgttatcagccctcgacaggcaggctcactcacagcgtgggcctccagtggcttgagccctgtatccagttgcat

SEQ ID NO: 139 - DNA, 3262 bp, Homo sapiens
  CDS (60)..(2279)
agcgggattcgatagcatactcagtgtggtggaattcgtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaaaaaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcga

SEQ ID NO: 140 - DNA, 3061 bp, Homo sapiens
  CDS (60)..(2078)
agcgggattcgatagcatactcagtgtggtggaattcgtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaaaaaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcga

SEQ ID NO: 141 - DNA, 5102 bp, Homo sapiens
  CDS (284)..(4234)
aggggggattgacccttgcggcaccggtccggaattcccgggtcgacccacgcgtccgggttcctgcagatagagtctgcctcccctgcccccttctcttctggattcctcgctgcccaccctcattctcccgggggaagcctcgcaacgaagggccggagccgcctttctgctcccggaatgcttcacctgtccgcagctccgcccgccccacccccggaagtgacggcgaccgcgcggccctgcctttgttccgttgggcgtccgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagtcacaacatcgcactgtcccaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatctttt

SEQ ID NO: 142 - DNA, 1510 bp, Homo sapiens
  CDS (60)..(884)
atttggccctcgaggccaagaattcggcacgaggaccactctgctcccccgcctaagccatgcacctctgtgggagcaatgggctgctgacccagacagaccccaaggagcaacaaaggcagctgaagaagcagaagaaccgggcagccgcccagcgaagccggcagaagcacacagacaaggcagacgccctgcaccagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctgggcccaggcatcctaggggctgaaatcctggaaaacccgtggggccttgggtggttgaaaaaaagggtttttgccaatggcctccaagaaggccaagaaaaaaaagggggctttctttccccccactggttttgtgattccaagggcccagagccatgccagtccccagaaaaccccaaccctaaacttggggcaagtcccagagtccaagcccctggtggggtaagaggccaaagcaagaagccctgaagtgggactctttgcttcccctaagaaggggt

SEQ ID NO: 143 - DNA, 2995 bp, Homo sapiens
  CDS (285)..(2351)
gcgtgttgtatataactatctattcgatgatgaagataccccaccaaacccaaaaaaagagatctctcgaggatccgaattcgcggccgcgtcgaccgcggccgcgtcgacagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccgaaagattagccttgtacaaaggggggatgacgcagaccaaatcgagccgccaaaagtatcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattcttttctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaaaaaaaaaaaa

SEQ ID NO: 144 - DNA, 1031 bp, Homo sapiens
  CDS (138)..(950)
  misc_feature (1)...(1031): n = a,t,c or g
atttggccctcgaggccaagaattcggcacgagaggggggatcgctgggagcggttgcggcgtgcggggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacaggggacaaggaaggaaaaagagggagggtctaaaggaaaaaggggcttgaagtcctttaggatatcttacagtttttattaaaaggaagccaattacactggaaccggggctccctatggatggcctgctggggattgcctgttcgagggnggacggttgggg

SEQ ID NO: 145 - DNA, 2130 bp, Homo sapiens
  CDS (184)..(1236)
gttttctccacatggaaacttattggcgtttgcctcgcgagacagaaccgtgagactctggattcctgataagagaggaaaattctcataatttaaagctcatacagctccagttcgaagtggagacttttcacctgatggccagtttctagctacagcttctgaagacaaatccataatagtatggagcatgtatcgccagcgcttcctgtattccttggatcgacatacacactgtgtacgctgtgcccaattgtacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaacccagatctctggatttcactgttaagtcatttcagattgaccatattcagacagtcatggggtgaaataattcacttacctccaaaatagcatcctatatggccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggccgactttgtttatccattggccaacctgaaggaaatgaaactcacctatctttctatcacagatgaatgcgctagatgaatgatttgggctggatctgaccatggttcacacaaattatgtcagggtggtgtagtgacggtaaatgtctgagtgattcgagagtgatttttatcatcctattccactgtaggggcacttgctcgagaaatattgctgttatgctgacttcggctgcttttcgtatctccttttataatcttcg

SEQ ID NO: 146 - DNA, 4515 bp, Homo sapiens
  CDS (44)..(1381)
cggaattgccggaccgacgatttcgtgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcagtaaaatgtatctggcgtgaacagcaggataacccatgttctccacataaggataaccttacgtgaaaccttcctgctgacaaccatgcagaggaattttttccacttaagtcagagccttcctccccatctggaattcacagctgttccctgggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttcaaaaaaaaa

SEQ ID NO: 147 - DNA, 5761 bp, Homo sapiens
  CDS (168)..(2885)
tttcgtcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctcgtcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttacgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcaccatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggccctgaagcacaggtgtccaaagaaaagcgttaagtccatcttaatagaatctatgtggtatatgatgtgggtcagcccctgggtctgtgatcagcaagaacctacagcacagattatgccctgcccacttcaatgaatacctactctcctccattctccatcactttttttgctgtcaagaactccggaccttgcccatggagaagtttagagaggaactcttgtggagagctggtttattttctgcccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactggtttctatttatatttgatttatatttcatttggagtctgttacatggcagcttaagcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaaaaa

SEQ ID NO: 148 - DNA, 2622 bp, Homo sapiens
  CDS (336)..(1799)
gcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaaggaaatttatccgaaaaaaaaaaaaaa

SEQ ID NO: 149 - DNA, 4285 bp, Homo sapiens
  CDS (346)..(3285)
taagcttgcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcactcagccctgatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaaaaaaaaaaaaaa

SEQ ID NO: 150 - DNA, 4618 bp, Homo sapiens
  CDS (282)..(4043)
cggaattcccgggtcgacgatttcgtcttcgcttgacgatttcgtaggggaggaggccgagtgtttcctggcgcattcccggccagcccgagtgactcactcggccaaggaaactcccagggcccgcccaggacccccaagccgccgcggacgcagaatgtggctcagctgcccctggtcccatcccagggcagagctcctcctgagtacccttgagactggagcagattcagcagaaggcagattgccccctctccctggagctggctctgaagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccactatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctgtacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctaaaaaaaaaaaaa

SEQ ID NO: 151 - DNA, 4244 bp, Homo sapiens
  CDS (230)..(2311)
gcacgagccctgccgggtggaaccgaggcggcggcggccgtggcgcggcgtggtggcggagggacggtggagacggctgccctagtgggagaggcggcgcggcgcgagtgaggaggagggtgaagcggcggcgtcgaaggagaatgcttggacagaagagatgagtactatttccactaaggcctataattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaagggagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaaaaaaaaaaaaaaaaaaaaaaaaaaaaaaagggcggcccaagctta

SEQ ID NO: 152 - DNA, 2703 bp, Homo sapiens
  CDS (398)..(2329)
atttggccctcgaggccaagaattcggcacgagccgtaggctccttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccagatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataatatagtagttttaaagttcatttggttgaattttcattttttcctgtcacagagcttctaaaaccatggaatttccttagtgatagggaatatcttttgttgttcataataagccccttttgatcacacctgagtttatgctaatgcggtgacttagggtgaggtctctaaatagcctttaacacctgcagcttgggaggccaaggcagagggatctcttgagtccaggagtttgagaacagcctgggcaacatgatgaaacctcatctctaccaaaaaaaaaaaaaaa

SEQ ID NO: 153 - DNA, 5092 bp, Homo sapiens
  CDS (455)..(4195)
ctcagaacaacgacagcggccgcctcttgtgtttgactcaatagcatccggggatgaaacaggagaacttttctgttactgtttcaacacaaaagacagcgcccgcctctttatataacccaggacgattttctgtcttacttgctcacctcatcatgaagatttagtagccattggctacaaggatggcatagtggtgataattgacatcagtaagaaaggagaagttattcataggcttcgaggccatgatgatgaaatccactccatagcctggtgtcccctgcctggtgaagattgtttatctataaaccaagaggaaacttcagaagaagctgaaattaccaacgggaatgctgtagcacaagctccagtaacaaaaggttgctacttagccactggaagcaaagatcaaaccattcgaatctggagctgttctagaggccgaggggtgatgattttgaaattgccctttctgaagagaagaggagggggtatagacccaactgttaaagagcgcctttggttgacactccattggcccagcaatcaaccaacacagctggtatctagctgttttggaggtgaactgttgcaatgggatctcactcaatcttggagacggaaatacaccctcttcagtgcctcatcagaagggcaaaatcattcaagaattgtgtttaatttatgtcctttacaaacagaggatgacaaacagctgttactttctacatcaatggatagagatgtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcgctgtgctggcacccaaccaaggaaggttgcttagcttttggaactgatgatggaaaagtgggattgtatgacacctactccaacaagcctccacagatttctagcacatatcataagaagactgtatatacgttagcctgggggccaccagtaccccccatgtcacttggaggagaaggagacagaccttcccttgctttatacagctgtggaggagaagggattgtcttacagcataatccctggaagcttagtggagaagcctttgacatcaacaaactcatcagggacaccaattcaatcaaatacaaattgcctgtacacacagagataagttggaaagcagatggcaaaatcatggctcttggcaatgaagatggatcaatagaaatatttcagattcccaacctgaaactgatctgtactatccaacagcatcacaagcttgtgaataccattagctggcatcatgagcatggcagccagccagaattgagctatctgatggcctctggctccaacaatgcagtcatttacgtgcacaacctgaagactgtcatagagagcagccctgagtctccagtgaccattacagagccctaccggaccctctcagggcatacggccaagattaccagtgtggcgtggagcccacatcatgatggaaggctggtatctgcttcctatgatggtacagcccaggtgtgggatgctctccgggaagagcccctgtgcaatttccgaggacatcaaggtcgactgctttgtgtggcatggtctcctttggatccagactgcatctattcaggggcagatgacttttgtgtgcacaagtggctcacttccatgcaagatcattcccggcctcctcaaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcggtttctagagaaccagttatctgcactccagtttcctcaggctttgaaaagtcaaaagtcaccattaataacaaagtcattttactgaaaaaggagccaccaaaagagaagccagaaaccttaatcaagaagagaaaagctcgttccttgcttcccctgagtacaagcctggaccacagatccaaagaggagcttcatcaggactgtttggtactagcaactgcaaagcactccagagagctgaatgaagatgtgtctgctgatgttgaggaaagatttcatctggggcttttcacagacagggctaccctgtatagaatgattgatattgaaggaaaaggtcacttagaaaatggccaccctgagttatttcaccagcttatgctttggaaaggggatctcaaaggtgttctccagactgcagcagaaagaggggagctgacagacaaccttgtggctatggcaccagcagctggctaccatgtgtggctatgggctgtggaagcttttgccaaacagctgtgttttcaggatcagtatgtcaaggctgcttctcacctactttccatccacaaagtgtatgaagcggtggagctgctcaagtcaaaccatttttacagggaagctattgcgattgccaaggcccggctgcgcccggaggacccagtcctgaaggacttgtacctcagctggggaaccgtcctagaaagagatggccactatgctgtagctgccaaatgctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacagggtcagagattggtgttttgccttctggagctactgtccaggcatctggaggaaaagcagctttcagagggcaaaagctcctcctcttaccacacttggaacacgggcaccgaagggcctttcgtggagagggtgactgcagtgtggaagagcatcttcagccttgacacccctgagcagtatcaggaagcctttcagaagctgcagaacatcaagtacccatctgctacaaataacacacctgccaaacagctcctgcttcacatttgccatgacttgaccctggcagtgctgagccaacagatggcctcctgggacgaggctgtgcaggcgctccttcgggcggtggtccggagctatgactcagggagcttcaccatcatgcaggaagtgtactcagcctttctccctgatggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtgtaaagaagaaaaaaatgagccactttctctgcctgagttaaccaaaaggcttaccgaggcaaatcagagaatggcaaaatttcctgagagcattaaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgattcaaatgtgtgttttcccttcagttttataacaaatggattgatggcagtcaaatagctcaggaataaattactgtttcaatggttcttaaactttcttggatcataggatccttttgagaatcagattaaagccaaagatactctttggagaaaaatgcatattcctaattttgcatagatgacctttggattattggactctgactattgggaccctaaatactatttaattataaatctttcttttctcctc

SEQ ID NO: 154 - DNA, 2274 bp, Homo sapiens
  CDS (116)..(460)
taattgggagaatactccagccataagatctgcatgcatagcatagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcacctttcaatacaatggtcttggagacaatatggagtgcaaaggcaacttagagggtcaagtaagcaagtcagaagggctttacatgtgtgtcaaaattacctgtgaagaaaaggccactgaaagtcattcaacctcttctacttttcatcggataattcctaccaaggaaaaattgtcaaatgtaaggaatgcagacaaggtttcagctacctgtcatgccttattcaacatgaggaaaatcataatatataaaaatgctctgaagttaataaacacaggaatacctttagcaaaaagccaagctatatttaacatcagagaattcagactgggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgattgtaagaaatgtggaaaagcctttagttattgtcacaatatactcttcatcagagaattcatagtggtgaaaaaccctatgaatgtaagattgtgggaaggcctttatcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacattatcatcaaagaattcatacaggtgaaaagccctacaaatgtaaggaatgtgacaaggcctttatttatggctcacaatacttagtgaacatcagagaattcacagaggtgaaaaaccttatgaatgtaaacagtgtggaaggcttttattcgtggctcacaccttacgaacatctgagaactcatactggagagaaaccctatgaatgtaaggaatgtgggagggcctttagtcgtggctcagaacatactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaactgctcattcttagaaggcctacttaacatggatgcagaataatttcagaaaccccttaaataattccttaacatctctataaacgctagaatataatgctgaattatatcctttattaagcatcatctccatttcaccatatcctaactgaaaccctatatatttcttgtgtgttcttttctatttgtaaatactgtaattgtattacatgactaaattatattaatactataattccccgg

SEQ ID NO: 155 - DNA, 6990 bp, Homo sapiens
  CDS (61)..(2397)
gggcggccgttcccgcggccccctcggctttgccagcgccgcctgcgaggcggaggcaggatgaagatgactggggatttcgaggagtgtctgaaggactcgccccgcttcagggcagctttggaagaagtagaaggtgatgtggcagaattggaactaaaacttgataagcttgtgaaacttgggattgcaatgattgatactggaaaagccttttgtgttgcaaataaacagttcatgaatgggattcgagacctggcccagtattctagtaatgatgctgtcgttgagacaagtttgaccaagttttctgacagtcttcaagaaatgataaattttcacacaatcctgttgccaaactcagagatcaatttaaggcacagcttcagtaactttgttaaagaagatcttagaaaattcaaagatgccaagaagcaatttgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggatttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctctttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatggccttcatccaaaactttaaagggaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgcttttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaaaaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaaatacacatttctgtggcttgatttcttgaatatgctgagacccaatttggactacatttggcagaaatcatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattgggttacttttccagacatacagatttaatttgggaatatggaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggaccatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctgaaaaaaaaaaaa

SEQ ID NO: 156 - DNA, 4053 bp, Homo sapiens
  CDS (409)..(3819)
  misc_feature (1)...(4053): n = a,t,c or g
cctaaggccctaattgaagagctgttgctatacaagcgctcanaagatcagatagaactgaaggaaaagcagttgtcaactatgagggtggatgtgtgcagcacagaaactctcaaatgcttaaaagataaaacaggtgggaagaagttctccaaagnatttgaagaggcaagctccaagctggaagaatttgtgaatggattagatanncaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggccgctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaa

SEQ ID NO: 157 - DNA, 1091 bp, Homo sapiens
  CDS (112)..(927)
gctataggagacccaagctggctagcgtttaaacttaagcttggtaccgagctcggatccactagtccagtgtggtggaattcgcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgaccccccccccatgttttattaaagggggtgctggtggtgaaaaaaaa

SEQ ID NO: 158 - DNA, 2418 bp, Homo sapiens
  CDS (467)..(2026)
gcgcacgtaagcttggatcctctagagcggccgcaatacatttgtggcttgttttcactacttttaagttactatcaaatctatacatctatctcgtttgcatgcttttaaattttatttttaaaaacatttagtggtgatatttatgaaaggaaatgattactttttttcttgactcttgtagaggaacttaaatggtttgaaattgtgactcagttaactctgtatccattcattcccagaaacaagccgcatttctccttggggagactgataatttaaaaggtttgttgtgtcagaaacattcccagcttcatcaccaaccctttccttccacctctgcccactggagaccacttacatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcgccccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgttttgaaaaaaaaaaaa

SEQ ID NO: 159 - DNA, 1711 bp, Homo sapiens
  CDS (664)..(1551)
ctccggaattcccgggtcgacccacgcgtccggcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaagtaaggcctgggccgggatccagggcaggggcaggtgggctcttgggtttccttggagggggcaaggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgttataaatgggggaaactgaggcacagcgaggttagtaacctgctgggtgttgcatggccagtgagtgaagaagcctgcatgggaacctggggtagtctggctgtagcagtgacgctgccggcccaagggctggggacttggggcagggatgagggggagtaggatgtcccagcccccgcagtgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgaaaaaaaaaaaaaa

SEQ ID NO: 160 - DNA, 2487 bp, Homo sapiens
  CDS (235)..(2469)
gcacgagtaaggacagaaaagtgaaatgcagtatggtgaagaggataccctgaatatgtatgaagacatgctgttgtgagacggagttgtgaaacagaggccacagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggcctcgccatgggcaaggagatgccccacttgcagtatggcaaagagtatccacacctaccccaatatatgaaggaaattcaaccggcgccaagaatgggcaaggaagccgttcccaagaaaggcaaagaaataccattagccagtttacgaggggaacaaggtccccgtggagagcctggcccaagaggaccacctgggccccctggtttaccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttcccaggtcccataggccccaagggggaacatgggcaaaaaggtgtaccaggactccctggtgttccagggcttctcggacctaagggagaaccaggaatcccaggggatcagggtttacagggccccccaggtatcccagggattgggggccctagtggccccattggaccacctgggattccaggccccaaaggggagcctggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaaaaaaaaa

SEQ ID NO: 161 - DNA, 1718 bp, Homo sapiens
  CDS (258)..(1697)
ttgaacgccttaggtaccggtccggaattcccgggtcgacccacgcgtccggtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaaaaaaaaa

SEQ ID NO: 162 - DNA, 1221 bp, Homo sapiens
  CDS (263)..(862)
ccgcgccgcaattcccgggtcgacccacgcgtccgggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaaaaaaaaaaaaa

SEQ ID NO: 163 - DNA, 2925 bp, Homo sapiens
  CDS (178)..(2433)
ttgcttgtccaccttccagctttaacgctctgcaacagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggctttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaataaaaaaaaaa

SEQ ID NO: 164 - DNA, 4631 bp, Homo sapiens
  CDS (184)..(3003)
aaggatccttaattgactttatccccgccctcgtatgcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggaaggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcatggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgccaaaaaaaaaaaaa

SEQ ID NO: 165 - DNA, 3292 bp, Homo sapiens
  CDS (118)..(2313)
  misc_feature (1)...(3292): n = a,t,c or g
tgaaacaannnnntttgatngcctttgatgggcgatccagctggctagcgtttaaacttaagctcgggaccgagctcggatccactagtccagtgtggtggaattccagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatggaacacaagggagtgtgcagttggagacagccagggaccacatgtacacggcctggtacgctttgacaaggactttggatcttactctgagtatgagagaaagcactgggaagtttcaatgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatcccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttccctgtgatttactgcattgcaggctgtatgataaaacccccataatttaaagagagaaggctcttgattccttatgcaagtggaaaagttgaaacttgattgaaggacttaaaacattcccacccttaagccgaggtggggggatatggggattcaggcagttgtttaccccctttgaataactgcaaaggatttacggtttgtgaaaaatgtgtactgtggaaaagataataaattgaagcccttaaaaaaaaaaaa

SEQ ID NO: 166 - DNA, 2306 bp, Homo sapiens
  CDS (1)..(2232)
atgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactaaatctaatttgtcgtctaaaattaatgaagacagataggattgtaggtcagaattctggaacatctatgaaagacttacttaaatttagaagacagtattataagaagtggtatgatgctcgtgttttctgtgaaagtggggcttccccagaggaggtagctgacaaagtgctgaatgcaattaaaagataccaagatgtggactcggaaacattcatttcaacaagacacgtttggcctgaagactgtgaacagaaggtttcagcaaaattctttagtgaagctgtaattgaggggttggcttctgatggtggcctctttgttcctgcaaaggagtttccaaaattaagctgcggggagtggaaaagcctagtaggagcaacctacgtagaaagagcacagatactgttggaaagatgtatccatcctgcagacatacctgctgccaggttgggagaaatgattgaaactgcttatggggaaaactttgcctgctcaaaaattgctcctgtcaggcacctttcaggcaaccagttcatcctggagttgtttcatggaccaacaggatcatttaaagatttgtctttacagcttatgcctcatatttttgcacactgtatcccaccaagttgcaattatatgatacttgtagctacttcaggagacacagggagtgcagtcttaaatggttttagtcgtctaaataagaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaattagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgaaaaaaaaaaaa

SEQ ID NO: 167 - DNA, 3454 bp, Homo sapiens
  CDS (340)..(2055)
atttggccctcgaggccaagaattcggcacgaggagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatctcaaaaaaaagtcgacgcggccgcgaattcggatcctcgagagatctctttttttgggtttggtggggtatcttcatcatcgaatagatagttatatacatcagcctgtctaatg

SEQ ID NO: 168 - DNA, 1197 bp, Homo sapiens
  CDS (96)..(548)
atggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccaactccttcgacagactcatccctcttctcccgcaagacttttattacgttgccatggatttcggaggtcatgggctctcgtcccattacagcccaggtgtcccatattacctccagacttttgtgagtgagatccgaagagttgtggcaggtaagaaacagagtgtgtattttcggcggtgtggggggtgctctagggcaccccctcttatcactggaggcggggtaggatccaggaagcagcgctggcctgagagtggggcctgggctctggccccaggtctgccagcaattcacgggagatcttgggaaagttgaagagttcgcttcctccagtgggtcccccaagctagtctcctgggtggacaccccagatgctgggaagggatttcctgagcctggggactagaagcaagatcgtgggctgagcctgtgcccagccggaccttctggctccttgcatttccagccttgaaatggaatcgattctccattctgggccacagcttcggtgagtacagtggccaggagctgaccgggcccggagtagggctgggagggaaggataggagctgctgccccacccctttcccctgcacttatgagatctgcaaagagagatgagagggtcagtcagaggttgaccactgtaccctctgacctcaggcaactgccgcaagggacacagggatgagggaaatgtggtcttttgagtggtcaggtctgatgaaggggacatcatggcccagatgctgagcccccagccacccatatggtgccccccccccaactggtgggaagaagctttagggtatgcagctggggagggagtgagggaatgtcacccacagctcttttgtcccccaggtggcgtcgtggacggaatggtgagtagatggctttgtctggccaactggggctcccttgggtggagtggggaggggagcacgaattccgccacagtgaa

SEQ ID NO: 169 - DNA, 2046 bp, Homo sapiens
  CDS (325)..(1320)
caaggagcacaggtcctcgttcaggacgatgtaatccttgccatcgtaagcaagctggtgatacccgcggagtaggcgcccgtccgaccccacgtcgcagacagacatcctctagatgggtgtgagaccctggccccgcccccgcggccagccccgcccaccgagccccgccctcgccaggaccaacctcgcggggattttggctgaaaatgaaaccgggtaacggctcctgggcctctcccgggtcaagggtctccaggtcccgctgcctcggcgtggatctcggacccagagactcggggagacccgggcggtccgtgggggatgtggaggggtagtgacctgcgcccccggccggtgtcactcacaggcctcactctggttgtagtagccgctcagggtccgcaggttcactcggtaaaactgtgctttggccttggcggtccctgtctcctcttcccaatattccggcccctcctgctccatccacggcgcccgcggctccatcctgggactcgtggcgtcgctgtcgagccgcacgcactgcgtgtcgtccacgtcgcccacggagaggaagcggggatccgcgcggccgggccgggacatggtggtgtggaaatacctcaaggagtaagcctgggagcaaggagggggctgagaccctcccgaccctcctcccggcaccgcaaccgggttcctgcgcccccgccgggcaggcccctagctactccccacagacgccgtttccctcccgaccccgcactcacctgcccaggtctgggtcaggaccagggcccccgagagcagcagaagcagggttcggggcgccatgacaccatcctcggcgactgggaagaatcggagtcccggtgggtgcgtgggaactttagaaccgggaccgcggctacattgattggcttctctagaaacccgacactcaatgggagtgagaactggggcagcccggtgagtacccaggaagaaggacccgacacaggttgggagagggagaagagaaaccctgcaaagatggggaatgcccagcgctgggcctccccaatccatacaccgcctttggggcctgagatcctgagagccacgcctgaggccctgggacttcgccctgaccccgctacttctgtgccaagcgctctgtctcaatgtttccctgagtcttggcccaggagctgtctgagaaaccagggagaaaccctcggaatgggccccgtccctctctcttcactttgcatcacggaatccccgtcccagaactggactccctgcctcctactccttacctgtccccgtggactcttctagaagaaaaatcaccccagggagcttgttgccagagagtgagcttgccctgggaatggaggtgtagagacagggttttttgttgttgttgtttgtttgttttttaaatctggaaaagttgtgcctgagtgcatgagatagaatagagaccagtttgctttttgtttattaactacagtgggtagcagaatcttggtaactcctaatgatcaggaatctaatcggccaaaaatgtgactttggtcccttgacatataaatgtgtctaaaagcattacaacaggaatcacaaagctcctaagtttcactttcccagacaatgtatctgtgactcccgcttgtagtattttaaatttaccttcattccatagccctgagtttctgtgtgagtccaggacatctcctaatacaaggtagccactgtgttactatatgttgtaaccaggagccagtacggactttattcatctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaaaaaaaaaaa

SEQ ID NO: 170 - DNA, 2062 bp, Homo sapiens
  CDS (785)..(994)
tgcacgaccggtccggaattcccgggtcgacccacgcgtccgggcggaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacactaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatagcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatccttctgtatgtattattaaagagaatatagcaaaaaaaaaaaa

SEQ ID NO: 171 - DNA, 2809 bp, Homo sapiens
  CDS (1936)..(2364)
tcccgggtcgacccacgcgtccgctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgcccccaccgccatcaccacctcggaacccagggtaacgctgtcagtctttggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagcttagacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 172 - DNA, 1882 bp, Homo sapiens
  CDS (181)..(1194)
ctccggcaggcgtgatgtatataactatctattcgatgatgaagataccccaccaaacccaaaaaaagagatctctcgaggatccgaattcgcggccgcgtcgacttttaaaagaatagatagacgttgaattattgatattctccctctctctctctaggatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagccctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaaaaaaaaaaaa

SEQ ID NO: 173 - DNA, 1713 bp, Homo sapiens
  CDS (170)..(1153)
aggggcttacaatcggacgctcgataccgctatgaccactacgcttttgcaaaaagctatttaggtgacactatagaaggtacgcctgcaggtaccggtccggaattcccgggtcgacccacgcgtccgcggacgcgtgggaggggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggggaatatcttataacatgtggatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgataaaaaaaaaaaa

SEQ ID NO: 174 - DNA, 4069 bp, Homo sapiens
  CDS (771)..(2894)
  misc_feature (1)...(4069): n = a,t,c or g
tttttgggaatttttggacgcggttaaccaaatttctccaaacgggaacacggttttgtccctgtttttcgcggtttttaatcaggcacccactatgaggggaaattttgccctcggaggcccaagaattggggcaggagggttttttttaaaatagtgcccagtccaagtgggaaatggagaatgaaacaaataaatctgtaaactggttgtgatcaattagttgtaaacaccgccgcactcagaccagccatgggtttgccctttgataagggcaaagacacatttttcgtggtatcagggaaaaagatttaaaaagacaaggcaaatttaagtaggctcatggcttttccagttgggttggaaagttcctctccgatgactgttatattctcaaagaaatatgaggagaggggcagggcatggtggctcacatccgtaatcctagcaaatcatatgtgcctacagccaacgccttcttcgctcactggccaactggaaacttcagtccccccatgcctcccgcctctcacccaggggccaataggaatgatcagaggttcgcaacttagtgtcatcaagcatagtaattgcaattggctattggagctgtcgatcgtgaagtatgcggggccgtccagcttgcctatataagacgaggacannacgccgccgcctgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaatacttgaaagtaagaaggtttagtaactgagccactgcgccaggccgattaataagatttctttggtattagttcacttgacagttatataatgttatgtttgagaatttggtaactctgattcttgtatcctttggagtaatcataccctttaattagcaggatcaggtgagctgtgtccagaaaaccaacgagaaggagtggaaggaggaatgaacgcttcattctcgttaataaaggcattatccaaattaaaaaaaaaaaa

SEQ ID NO: 175 - DNA, 1830 bp, Homo sapiens
  CDS (104)..(1000)
attgataacggagatcgagctcgctagcgtttaaacttaagcttggtaccgagctcggatccactagtccagtgtggtggaattcagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattggatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaagaatctgcggtatttttttaaaaaaaaagtttactgctgtagtgtgaaatattgtctggaaagggatggtttaaatatccccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaaaaaaaa

SEQ ID NO: 176 - DNA, 2430 bp, Homo sapiens
  CDS (1)..(1668)
atgggcccccccatcgagaccctagtccgtgtggtggaattcccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaaaaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgaaaaaaaaaaaaa

SEQ ID NO: 177 - DNA, 1670 bp, Homo sapiens
  CDS (278)..(658)
ctgcgatgaggatgatgtatataactatctattcgatgatgaagataccccaccaaacccaaaaaaagagatctctcgaggatccgaattcgcggccgcgtcgacctagggtgttgtgagtgtaaattagtgcgatgagtaggggaagggagcctactagggtgtagaataggaagtatgtgcctgcgttcaggcgttctggctggttgcctcatcgggtgatgatagccaaggtggggataagtgtggttgcgaagtgggctcgtgggttggcagtatgagagttgtaatggcccgactgttgagtgagggggagcaggggatcccaacggcttgcgctgcctttgcgcagcagccggcgggcgagccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatattattctttactttaaaatgctttattggaattattttgataaaagcaaatacttgtatataagacaaatataggaaatagaagctatctacttgaagtgccccctaattttcaggcatttttcccccaataaggtgacagctgctcacacaggataatacaggaaagttgtaagttcttaggatatgcccagcaccaggcggaagatattgtgtcagcaaattccatagcaaggaaggagaacaggcatggctctccacctctcccagcctgaaggtcaagttgcaggaatcactgtctaagcatgacagccatacaaagcttctctccatgagggggagattccaaaccttagaccttcactcagattagtgcagaatctctgtgaaggtgcattgtccctggctgggcttccagagttcattctttactcaaggataacacggcgatgaacgtcttacaactcagttgttttgagtcagcaggggctgtggggccgctagccgagttccccctgccacgagctaggtcagttccaagcaaagacaccagaaactccagtgtgcaacggtagttcacccaactgcactggggaccgccctctcctaccccagccaggccgcgacgtggccgcccgccggctgctgcgcaaaggcagcgcaagccgttgggatcccctgctccccctcactcaacagtcgggccattacaactctcatactgccaacccacgagcccactctcgtgccgctcgtgccgaattcttggcctcgagggccaaat

SEQ ID NO: 178 - DNA, 1702 bp, Homo sapiens
  CDS (167)..(1093)
tatgatgaccgttgtaccggtccggaattcccgggtcgacccacgcgtccgcgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcaaaaaaaaaaaaaaaa

SEQ ID NO: 179 - DNA, 2821 bp, Homo sapiens
  CDS (234)..(2492)
atttggccctcgaggccaagaattcggcacgaggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacaaaaaaaaaaaaaaa

SEQ ID NO: 180 - DNA, 1494 bp, Homo sapiens
  CDS (184)..(498)
ctcccaagtccagttatttttcctctctaatagagacaaacgagacacattttatccatggacccaaaactctggcgccagtcaccaacttaggaagacagcctacccttggtgtttaatcattgcagggtgtgcctgcttgattattcacccacaccccattggtgtctgatcaccacggggatgcctgccttggtcattcacccacattcccttggtggcaagtcaattgtggggacacgtgctttggctgctcacccacattgcagcccaggactgctccccaccccgcttctccgtgtctctacccttctctttaaacttgcctcctttactatgggcaaccttccaccctccattcctccttcttctcccttagcctgtgttctcaaaaacttaaaacctcttcaactcacacctgacctaaaacctaagtgtcttattttcttctgcaacaccgctgggccccaatacaaactcgacaatgattccaaatagccagaaaacggcactttcgagttctccatcctacaagttctagataattcttgtcataaaatgggcaaatggtctgaggtgcctgacgtccaggcattcttttacacattggtccctccctagtctctgctcccaatgtgactcatcccaaatctttcttctttctctcctttctgttccttcggtctccaccccaagttccgagtcctctgaatccttcttttctatggactcatctgacctccccccttctccccaggctgctcctcgccaggctgagccaggtcccaattctcacttagcctctgctcccccaccctataatccttttatcacctcccctcctcacacctggtccggcttacagtttcattccgtgactagccctcccccacctgcccagcaatttactcttaaaaaggtggctggagctaaaggcatagtcaaggttaatgctcctttttctttatcccaaatcagaagtgtttaggctctttttcatcaaatataaaaatccagcccagttcatggctcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggcaagggaatgcccgcagcccgggattcctcctaagccgcgtcccatctctctgggaccccactgaaaatcggactgttcaactcacctggcagccactcccagagcccctggaag

SEQ ID NO: 181 - DNA, 1682 bp, Homo sapiens
  CDS (889)..(1056)
tccttccgccatgcttggcacgaggcgcagaaggctgcaggccctataggggacgacgggctggggacgccctgagcttcctggctgtgtggcaggtgctggggaagctctctgggccatagggacctggctcccctctgagaggcccgcctgccctgggacacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccacggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgcgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggcaaaaaaaaaaaaaa

SEQ ID NO: 182 - DNA, 3526 bp, Homo sapiens
  CDS (118)..(3159)
agacccaccgggccggaattcccgggtcgacgatttcgtccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctttgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaaaaaaaaaaaaaa

SEQ ID NO: 183 - DNA, 1428 bp, Homo sapiens
  CDS (38)..(1306)
  misc_feature (1)...(1428): n = a,t,c or g
gcacgaggcgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgcttgctgcttgcccgccccgcttacagaggcaatgttgaccagtcacaggggacagttcacatnttccccagagttggcaatttttgggttnaaaccttttttaagatt

SEQ ID NO: 184 - DNA, 2086 bp, Homo sapiens
  CDS (212)..(1561)
aattgatacgcctgtcaggtactaggtccggaattcccgggtcgacccacgcgtccgcccacgcgtccgggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgcacatccagcctccgtgtgcatgtccagctgctgcgtgtacttccggccttgggccattggctggctgtggccttcgccctgatagtttgttcactggcagtggtgacagcagcagcaaacagcttagttgagcaaatggagcagaatggtcaatggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaagcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaaaaaaaaaaaaaa

SEQ ID NO: 185 - DNA, 1927 bp, Homo sapiens
  CDS (212)..(1402)
aattgatacgcctgtcaggtactaggtccggaattcccgggtcgacccacgcgtccgcccacgcgtccgggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaagcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaaaaaaaaaaaaaa

SEQ ID NO: 186 - DNA, 2146 bp, Homo sapiens
  CDS (212)..(1621)
aattgatacgcctgtcaggtactaggtccggaattcccgggtcgacccacgcgtccgcccacgcgtccgggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgcacatccagcctccgtgtgcatgtccagctgctgcgtgtacttccggccttgggccattggctggctgtggccttcgccctgatagtttgttcactggcagtggtgacagcagcagcaaacagcttagttgagcaaatggagcagaatggtcaatggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaaaaaaaaaaaaaa

SEQ ID NO: 187 - DNA, 4419 bp, Homo sapiens
  CDS (144)..(3425)
ttttttttttttttttttttttttttttttttttttttttttttttttttttttttttttttttttttttttttttttttttttttttttttttttgccgcccactcagactttattcaaagaccacgggcgaccggagcgcgatggctggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggttggcggtgcgctacggggctgcatttacccagaaattttcttcctctatagccccacacattactacttttctggtacatgggaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcacgctgaaaatacgaatcgggtggatcatccatgccatggagtatgaacttcagatccgtggcggagacaagccagccttggacttgtatcagctgtcacctagtgaagttaaacagcttctgctgggtatactgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaa

SEQ ID NO: 188 - DNA, 1521 bp, Homo sapiens
  CDS (595)..(1083)
  misc_feature (1)...(1521): n = a,t,c or g
ttttttaaataaaatagaatgtatttctctccatacgacaatcttaggatagtccagggcaggtaggcaattccgttccacaaggtcataaggagaacaggctagaggagcagccctctcttccttaacatgtaatttctgaattttggtcccagtgagtcctgtacttttcatcatttccgagccagagagaagagggaaaaagaatagaagacaggcaaatttctcataaaaataaaatccagaaggcacacatttcacttctgctaacatctcattggccaaaacttagaacctggctatagttacctgcaaaggaggctggaaatgcagtctctagctaagcaatcatatgtcagaaattggcatttccaaatacccagtggatattcatcaggatatacaaatgagaagttggaancctgggaattcttagaaatttctgaaataataagttatccttttaaaaaaaaaaacttttattttaggttcagggatacatgtataggtttgttataaagataaactcgtgttattctgaaaagacttccatttgcagacatcgctgctgcccagaactccctgccaccagccatggccaaccccactgtgttcttcaacattgcaattgatagtgagtccttgggctgcatctccttcaagctatttgcagacaaagttctaaagatggaagaaaatttttgtgctctgaacactggagagaaagtatttggtgataaaggtccctgcttttacagaattattccggggtgttgtcagggtggtgacttcacacaccataatggcactggtggcaagtccctctacagcaaggaatttgatgatgagaacttcatcctaaagcatacagctcctggcgtcttgtccacggcaaatgctggacccaccacaaatggttcccagtttttcatctgtactgccaagacagaggatggatgccagcatgtggtctttggcaaggtgaaagatggcatgagtattgtggaagccctggaacgctctgggtccaggaatggtaagaccagcaagaagatcacagctgctaactgtggacaactctaataaatttgattgttttatctgaaccaccagatcgttccttctatagctcaggaaagcatgcttccaccccatttgctcacagcatcctataatctttgcacagtcctttgggttccatattttccttatcctcttccatgtctagctggatcgcagagttaagtttataattacaaaatgaaaactaagtaacaagaagaaaataaaagacttccagcaatttttatactctttagtcattactgtggatatctaaaagaaattggtttaataaataagaaatattacatttagcaaatttataaacaactatagcctgagattnngngngntcaaactttagaaaataccagtgaacatttttgggtaatattcaaagaatgtgacattcagatctcntggnttccncgacggttcctcaggtctctaangggacct

SEQ ID NO: 189 - DNA, 2413 bp, Homo sapiens
  CDS (258)..(1922)
aagctggtacgcctgcaggtaccggtccggaattcccgggtcgacgatttcgtcccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagcagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcaaaaaaaaaaaa

SEQ ID NO: 190 - DNA, 6088 bp, Homo sapiens
  CDS (170)..(3448)
ttaactgccagctaaagtaaccctcactaaagggaataagcttgcggccgctcatttttttttttttttttttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaataggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattctttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctccaaaaaaaaaaaaa

SEQ ID NO: 191 - DNA, 1915 bp, Homo sapiens
  CDS (179)..(1522)
acgggccccatagaacgcctgaggtaccgctccggaattcccgggtcgacccacgcgtccggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggcgtctttggatcacactgcgcggctgctggctccatcacaaaacaatgaaggaggaagtgggacgcagagagaaacgcacatggggagaacgccacgtgaaggctgaggtcgggataatgcatctgcaagccaaggaacacctaagaggaccagcaaaccaccagaagccaggggagaggcgtggaacagaccctgccttacagctgtcagaaggaaccaaccctgccaacaccttcctgttgtactttcagcttccagaactgtgcctgcagggcttgagagaaatggagacaaagaaggccgtgggcaggaggccaagagaagcccagcag

SEQ ID NO: 192 - DNA, 1136 bp, Homo sapiens
  CDS (82)..(918)
atttggccctcgaggcaagaaattcggcacgaggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctcttaaaaaaaaaaa

SEQ ID NO: 193 - DNA, 1486 bp, Homo sapiens
  CDS (103)..(915)
atcgtataggcagtacccagctggctagcgtttaaacttaagcttggtaccgagctcggatccactagtccagtgtggtggaattccgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgaaaaaaaaaaaa

SEQ ID NO: 194 - DNA, 2353 bp, Homo sapiens
  CDS (153)..(2309)
ccggaattcccgggtcgacgatttcgtgcggaggtcgcggcgagccgggccgagcagtgagggccctagcggggcccgagcggggcccggggcccctaagccattcctgaagtcatgggctggccaggacatcggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcgcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctcaaaaaaaaaaaa

SEQ ID NO: 195 - DNA, 3996 bp, Homo sapiens
  CDS (52)..(3996)
gccgacagtccctccttgtctgtctccgggattcaggcctccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacgactggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccagctcttgtgactgtggccctggtcactgtcctgagactgaccctgtttctctgctgcagtatgtcgggcagtctaggctctgggagctgaatacccaggccccagtccccctcaccctaggcccctgtgccaagtttgtctgccgcttcttgcccaggatcctgggggtcgtggctaccccctcctctggccggctccttgctgctcctgtcatagactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccgacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccagccttggctgcccgcagcccccacccaaccccacgttctacgggatccccaacccggcccggctcagttccccagcccgctcttccttcccgctccagccatccgcgacccttggctccctccttgtatgtggcccacaggtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgatgagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcagggttggaggggctggggagactgggcgtttcggtgggctgccactgcccctgatggaactcatggagaatgaagctctggaaatcctcaccaaagccctccggagtaagctccccgccaacccccaagaactcccacgacagattctggtggattttgcagggctggggcccagggggagatgcaaagttccccaggctaacacagacctgagtgccctgcgctactgctacctcgaatcatctgcggttcctcgaatcacacatgcggcgccccctggctaccagttagggatcggcagggaccacttcctgactaaggagctgcagcgatacatcgaagggctcaagaagcgccggagcaagaggctgtacgtgaattaa

SEQ ID NO: 196 - DNA, 1332 bp, Homo sapiens
  CDS (171)..(920)
actctggaacgcctgcaggtaccggtccggaattcccgggtcgacccacgcgtccggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgtatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataaaaaaaaaaaa

SEQ ID NO: 197 - DNA, 2128 bp, Homo sapiens
  CDS (42)..(1031)
taagcttgcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcaggtgtctgtccctcgggctccggacggcactgaccagatgtctgctggccggtggtggccgaaatcatgggacaggctgggctgaaggcttggtggcactgagtgggcagtggtcactgtgggggtgggagaagcctgggggggcgcttcctccttccttgagcagaaatgtgtgtctcgcctctcttcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttattttattcacctatttttataataaacgttcttgctgctgtgaaaaaaaaaaaaaaa

SEQ ID NO: 198 - DNA, 668 bp, Homo sapiens
  CDS (136)..(498)
aggctcgatgtatataactatctattcgatgatgaagataccccaccaaacccaaaaaaagagatctctcgaggatccgaattcgcggccgcgtcgacctcccctacagaagcccccagagcgcagcacctcaccatggactgcacctggaggatcctcttcttggtggcagcagctacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggagcttttgatcctgaagatggtgaaacaatctacgcacagaagttccagggcagagtcaccatgaccgaggacacatctacagacacaggctacatggggctgagcagcctgagatctgaggacacggccgtgtattattgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaaaaaacgaaatcgcgacagcgaagtcgacccgggaa

SEQ ID NO: 199 - DNA, 2310 bp, Homo sapiens
  CDS (201)..(2105)
gggcatgcggtaccgctccggaattaccgggtcgacgatctcgagtggctagagctgaaaggcgaccgctggtgtcaaacatcttagctcaaatatctgggaacgattgcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacagagaccaaggatgctgctaaagatgctcgggatcagaaatgtttcagattttgatttttttcggattttggattccttgcattatttttactggttagcatctgtagtctgaaaatctgaaatctgaaatgctccaaagagcattacctttgagcatcatgttgatactcaaaaacttccggattttggagcattttggatttcagattattggattagggatactcaacctgtatttcagtgggttttatttgtaattttctgattactaataacattgagcatcatttcaaatgtttagtaactatatgtagggg

SEQ ID NO: 200 - DNA, 1835 bp, Homo sapiens
  CDS (32)..(1603)
ggaattcccgggtcgacgatttcgtgcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaaaaaa

SEQ ID NO: 201 - DNA, 4029 bp, Homo sapiens
  CDS (316)..(1842)
gacggcaagtgccaagctaaaattaaccctccactaaagggaataagcttgcgccgaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgagcttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagaaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgattttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcaagaaatttgtatgcgtatataagcaaatatgtaatctttattttttaaataaatgggatcatattatatattctaaaaaaaaaaaa

SEQ ID NO: 202 - DNA, 914 bp, Homo sapiens
  CDS (182)..(568)
cctgctctgtagagccggcggcaaccgggtagcttggccaggttgtgaggaaccgcagcgcccgcaggaccgggccgctgagcctgcagccgccccgcgccgtgacctgcgaccctagaccccgactccctttggctcagcccgcgcgccccaggcccggcccgggcggcgcgacgggaggatgagcggcgggcgcggaaggaggagccgcctcagccgcagctggccaacggggccctcaaagtctccgtctggagtaaggtgctgcggacgacgcgcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccccccccctttggggaagcatttttgaatttatccatccccaaccatttttttttggataccatcaagtaacagctattatttgccaagtggagctgtcatttaatttgatgcccctctggattcagatgaaacattaaattgttttcctcgattttcaa

SEQ ID NO: 203 - DNA, 1131 bp, Homo sapiens
  CDS (93)..(1082)
tttgaacgccttgaggtaccggtccggaattcccgggtcgacccacgcgtccggaaagcttggttacaacccgggacacccggagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaattg

SEQ ID NO: 204 - DNA, 1854 bp, Homo sapiens
  CDS (142)..(1758)
tcatccaggcttcgcccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagggtggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactaaaaaaaaaaaa

SEQ ID NO: 205 - DNA, 2785 bp, Homo sapiens
  CDS (402)..(2282)
caaggtgcggcgggtagtgtactcattcgaaggagaatacccccaattcactagacgagcccctaattgggggtgcggtgccgggcgcgctctttcctccccctttccaccagcactgccctcagttctgcttctagccacgccctttcgcgttcacgtccagcgccctggcgggattgatttgaggacgactggactgccattgcgcctgcgcagggagcccaaggcaagagccgctaggctgccctgcccgaagggctcaactgtcagtgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatccatggccacattgagctccaccctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttggaatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgctttaattttgtattttgaatgtacacgcatgctgaagctaagtaacttttaatcaaagaaataagatggtattaggcaaatcttactatactatgaaaagcattaccttgcctatttttaatattattaaagcctttctccttcagtagtctattttcttagaataacaactcttttatctattctgaactctattttttttcttttttaagagacaaggttttgctctgttgcccagcttggactcgaactttcctgggctcgagcgaccctcctgcctcagccccccaagtagctgggactaaagtcatgtgccaccacacccagcttactctgaacttttatgacagatgattgttttttgtttttaatgtagaaatgagacaagggtacaaattggaactagaaa

SEQ ID NO: 206 - DNA, 2310 bp, Homo sapiens
  CDS (750)..(1427)
  misc_feature (1)...(2310): n = a,t,c or g
ctgacatcataataaagtctacattttacaacgcaaacgaacaaaaatgtcctgctcagtgctgccccgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataattgaaccataactgccctttggcatcttgcctcttctgggaggcttaatttcttacaaatatgtggctctgcttttcaaatcttagtttgatgattttctcttcttcntttttcaggttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagagacgtgagtcttgctgtgttgcccgggctggctttgcctctggaactcaagcgatcctcccacctcagcctctcgaggagctgggactacaggcgtgcaccatcatttcctcctaaaatttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacaagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaatgtgccattttccttgccgcgttaatacaactgagtacaaaagttccaagagagatgctctcttttcaggggctgcaatgtcctctctgagacctagtggtggatgaggtctcctgtttgattttgttcctgcactcactcatttttccagagacccagctgtgattcacaggtgtcagacatggggaggtgtgagccttgcttgctacagcctgtaggatgagtttgacgtggccagcagcaccatctggtcaacctcattccagaatggcacagtcacaagtgaagcatgccactgtcaaatccgagaatgtaaaccgctgaacagctatggatcaaatggtagccctcaaaagatatgttcatgccctaaccctcagaacctataaatattactttatttggaaaagaatctttgcagatagaattaagaattttgagatgggtcattatggatcatcccagtgaacctaatgccattcacgagggttcttatncagaggacaggtagaggggagatttggagtacagaaggacaagatattncgtgtggatggtggcagacagagangggagttgatggccaccacaggccaggcatg

SEQ ID NO: 207 - DNA, 1341 bp, Homo sapiens
  CDS (210)..(1145)
gcacgagggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaa

SEQ ID NO: 208 - DNA, 1262 bp, Homo sapiens
  CDS (210)..(1067)
gcacgagggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaa

SEQ ID NO: 209 - DNA, 2038 bp, Homo sapiens
  CDS (102)..(1364)
gcacaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggatgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgccatcctgctggcccggagtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttaaaaaaaaaaaa

SEQ ID NO: 210 - DNA, 2022 bp, Homo sapiens
  CDS (133)..(1548)
tagtgccaattggttcgttgtcataactatctattcgatgatgaagataccccaccaaacccaaaaaaagagatctctcgaggatccgaattcgcggccgcgtcgacccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctattagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctaaaaaaaaaaacattacattcatgttctaattataaattttaaagttaggtactacaggcaggggggaaattgtaaagaattagcaaaattaggcttatgtacaaaaccaaaatttggccatgaaattttgcctttccatgcttccctcagttcaccaaagttaccaaaatgtaaaataaaataaaactggctcaggtaagtagggctgccaaccc

SEQ ID NO: 211 - DNA, 2843 bp, Homo sapiens
  CDS (286)..(1725)
gtgctggcttgatgtacctatctattcgatgatgaagataccccaccaaacccaaaaaaagagatctctcgaggatccgaattcgcggccgcgtcgaccaaggtcctccagcgttcctagagcggagaagaaagcgctccgaagagctagagctgacactcggcgatgagctaagacgctgtttcagagcgtttgggtcctctgaggccccttgaccaggagtgtctctgaagatacagtccaaagaaagttctccaaaacaaggagagcagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggtggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaatcctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaaaaaaaaaaat

SEQ ID NO: 212 - DNA, 3134 bp, Homo sapiens
  CDS (110)..(2812)
gcccccgtccatatgaggcaatggagaccctgcagtaccggtccggaattcccgggtcgacccacgcgtccgccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccctgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaagtcgacgcggccggatatttaatagtagtagtcgacccgggaattccggaccggtacctgcaaggcgtaccagctttccccaatagtgaattcgtatta

SEQ ID NO: 213 - DNA, 3059 bp, Homo sapiens
  CDS (110)..(2737)
gcccccgtccatatgaggcaatggagaccctgcagtaccggtccggaattcccgggtcgacccacgcgtccgccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccctgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaagtcgacgcggccggatatttaatagtagtagtcgacccgggaattccggaccggtacctgcaaggcgtaccagctttccccaatagtgaattcgtatta

SEQ ID NO: 214 - DNA, 3068 bp, Homo sapiens
  CDS (110)..(2746)
gcccccgtccatatgaggcaatggagaccctgcagtaccggtccggaattcccgggtcgacccacgcgtccgccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccctgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaagtcgacgcggccggatatttaatagtagtagtcgacccgggaattccggaccggtacctgcaaggcgtaccagctttccccaatagtgaattcgtatta

SEQ ID NO: 215 - DNA, 3071 bp, Homo sapiens
  CDS (110)..(2749)
gcccccgtccatatgaggcaatggagaccctgcagtaccggtccggaattcccgggtcgacccacgcgtccgccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccctgaagccagcagttgtagagactgttacaacagccaagccacagcagatacaagcgctgatggatgaagtgacaaaacaaggaaacctcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaagtcgacgcggccggatatttaatagtagtagtcgacccgggaattccggaccggtacctgcaaggcgtaccagctttccccaatagtgaattcgtatta

SEQ ID NO: 216 - DNA, 1302 bp, Homo sapiens
  CDS (427)..(1107)
atttggccctcgaggccaagaattcggcacgataaggaggagagaccaaaagggaggcctgaactctcaaactccgaatctgattttcactctcccaggaaggcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaaaaaaaaaaaaa

SEQ ID NO: 217 - DNA, 1512 bp, Homo sapiens
  CDS (150)..(1415)
gcacgaggcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctaaaaaaaaaaaa

SEQ ID NO: 218 - DNA, 2727 bp, Homo sapiens
  CDS (272)..(2353)
aattcggcacaggagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaaaagggcggccgctctagaggatccaagcttacgtacgcgtgcatgcgacgtcatagctctctccctatagtgatcgtattataag

SEQ ID NO: 219 - DNA, 550 bp, Homo sapiens
  CDS (6)..(509)
cagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaaaaaaaaaa

SEQ ID NO: 220 - DNA, 2742 bp, Homo sapiens
  CDS (842)..(2014)
acctccctccgcggagcagccagacagcgagggccccggccgggggcaggggggacgccccgtccggggcaccccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggagcctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtgctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcag

SEQ ID NO: 221 - DNA, 1994 bp, Homo sapiens
  CDS (123)..(1463)
ccagtgcggtggaattcggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaaaaaaaaaaaa

SEQ ID NO: 222 - DNA, 2363 bp, Homo sapiens
  CDS (317)..(1582)
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagatcacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacagaaaaaaaaaaaattagccaggcgggggggggcacacctgtagtcctagctacttgggaggctgaggcaggaaaattgcttgaacccaggagggggaggttgcagtaagccaagatcacaccactgcactccaacctggacaacagagcgagactccatctcaaaaaaaaaaaaaaaggggggccgttttaaagaacccttgggggggcccaagtttaccgggggttggaagaggaaaattttttcccttatggggggcggattaaaagccg

SEQ ID NO: 223 - DNA, 2457 bp, Homo sapiens
  CDS (175)..(1938)
gcacgaggagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctcaaaaaaaaaaa

SEQ ID NO: 224 - DNA, 2335 bp, Homo sapiens
  CDS (105)..(1853)
gcacgagctcaaccgagttgtcgtgttgccctcgcttctcagatccccgccggaagtgaagagagcaagcagatttgaacctatctgctttcaagctggtcatcatgatgaaacttagacacaaaaataaaaagccaggtgaaggttccaagggccacaagaagataagttggccctaccctcagcctgcaaagcaaaatgggaagaaagcaacctccaaagtgccctctgcacctcattttgttcaccccaatgatcatgccaatcgagaggctgaattaaagaagaagtgggttgaggagatgagggagaagcagcaagccgcccgggagcaagaaagacaaaaacgcaggaccattgagagctactgtcaggatgtcctaagacgccaggaggagtttgagcataaggaggaagttttgcaggaattaaatatgtttcctcagctggatgacgaggccacgaggaaggcttattacaaggagttccgtaaggtggtggaatactctgatgtgattctggaagtcctggatgccagagacccattaggctgccgctgcttccaaatggaggaggctgtcctgcgagcacaaggcaacaagaagctggtcctggtcttgaacaagattgacctggtccccaaggaggttgtggagaaatggctggattaccttcggaatgagttgccaaccgtggctttcaaggccagtacccagcatcaggtcaaaaacctgaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtcttcccaatgttgggaagagcagcctgatcaatagcctgaagcgcagccgcgcatgcagcgtgggagctgttcctggaattaccaaattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggagatttccaactattatggcgtctctgggttccagaccactgagcactttctgacggcagtggcccaccgtttggggaagaagaagaagggaggcttatatagtcaggaacaggcggccaaagctgtcctagctgactgggtgagcgggaagatcagcttctatataccaccaccagccactcacactctgcccacccatctcagtgctgagatcgttaaggaaatgaccgaggtctttgacatcgaggatactgagcaggccaatgaagacaccatggaatgcttggccaccggagaatctgatgagctgttgggtgacacggacccacttgaaatggagatcaagttgctccattctccgatgacgaaaatagcagatgccattgaaaataaaaccaccgtgtataagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctgggtgctgtggctcacgtctgtaatcccagcactttgggaggccgaggtgggcggatcacctgaggtcgggagttcgagaccagcctggccaacatggtgaaaccccgtctctactaaaaatacaaaaaaatttagccgtgcttagtggcacctatagtcccagctacttgggaggctgaggcaggagaatcgcctgaacctgggagactaaggcaggagaatcgcctggacctgggaggcagaggttgcagtgagcccagacggcaccattgcactctagcctgggcaacaacacgaaactccgtcccaaaaaaaaaaaaa

SEQ ID NO: 225 - DNA, 716 bp, Homo sapiens
  CDS (201)..(596)
tgcaggtaccggtccggaattcccgggtcgacgatttcgtcacgatcacacagcaccagacttcggttccctatgcccctggatggtgacggcggattggcatcttggaagcgatgcgagagcgataaggctggcgccggcccgcaaaagctgcaggagcatcgctaggtgttgccgccaccgggaagcggggctgcaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagt

SEQ ID NO: 226 - DNA, 6396 bp, Homo sapiens
  CDS (160)..(4983)
cccgcaattcccgggtcgacgattatctgggcacccggcagccacagcgcagcgagagcggacggtcgccatggttccctccccagccagtcccaggcgcccggtgcactatgcggggcacgtgcgccccccagctctaatctgcgcgctgacaggagcatgatctgtgcccaggccagggctggcaagaatctgtaccagaacaggtttttaggcctggccgccatggcgtttccttctagaaactcccagagcctacgccggtgcaaggagccgatccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatcgtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtccaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgctgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcataaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacatttttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggt

SEQ ID NO: 227 - DNA, 1555 bp, Homo sapiens
  CDS (385)..(1059)
accctattccgtgtgcggaattcccagcagatcttctggaggtgctgaagaccaattacggcatcccctccgcctgcttctctcagcctcccacagcagcccaactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtggtgtctgtgctgtgctgctttggtctctggatccctcgttccctggtgcctggggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggccgcagtgagcaatggttgtgccatacactccagcctgggtgatacagccagaccctgcctctggaaaaaaaagaaagcttactgagctttcctaaagcagatgaaaagaagagtatatagtatt

SEQ ID NO: 228 - DNA, 955 bp, Homo sapiens
  CDS (80)..(583)
ccggtggttgattccccttgagaaacgccttggcgtgaatctgaatttaggtgacactatagaagagctatgacgtcgcatgcacgcgtacgtaagcttggatcctctagagcggccgcctactactactatacggctgcgagaagacgacagaagggcgactctcacctctcatgtgcttctggccagtaggtctttgttctggtccaacgacaggagtaggcttgtatttaaaagcggcccctcctctcctgtggccacagaacacaggcgtgcttggattcttgacaagcagccctgctcctgcagaggagacagccacatttggaattgggcaccgagaagacctgagaaaaacccactctctctttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcaaaaaaaaaa

SEQ ID NO: 229 - DNA, 956 bp, Homo sapiens
  CDS (56)..(823)
agtgtgcgtggaattcgctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtgaatcccatcctgaaaaggaaggtgttacctactaagagatgcctggggtaagccgcccagctacctaattcctcagtaacatcgatctaaaatctccatggaagcaataaattccctttaagagaaaaaaaaaa

SEQ ID NO: 230 - DNA, 1685 bp, Homo sapiens
  CDS (61)..(1338)
aatgatacccgtgcggcaccggcccggaattcccgggtcgacccacgcgtccggttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaatttggtgtctttgtttaatgatctgttatttcactcccagatgtgtgt

SEQ ID NO: 231 - DNA, 1593 bp, Homo sapiens
  CDS (151)..(1437)
gcacaggactttgcctcggtccagctatgtgttcagcccggaatctgaagtgtcagcccaggcgtctctgaagaccgactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaatttatgttctaggatgaccaagtagaagaatactttgaaaaaattgataatgccttctggctatacagtgcccattctgcatttattccaccaaccgccccgctgccatggagtgccacctcaagacccactacaagatggagtacaagtgccggatctgccagacggtgaaggccaaccc

SEQ ID NO: 232 - DNA, 1234 bp, Homo sapiens
  CDS (342)..(1046)
tcttgggttgacccacgcgtcccatgccacgtcctgctctgttgaacacggatgtgtgcagagcattctctttctttacaaatctgatgtggggagaggaaagatgaatttttatttcataaagccactagatcagcaattctgacccctgtgaccacagagttcccatccacgcggctgacgacatgaccagacaagttcgggggttcagagcatctccatcccccttttggggactcagagcgtctccatcccacttttggggattcagagcatcttggtgaaacctcgggggctcagagctcccacctgaagaagccctctttattcaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattattggtatttctatgatatcacagtaaccaattaaatactatctgtaactttaaaaaaaaaaaa

SEQ ID NO: 233 - DNA, 3542 bp, Homo sapiens
  CDS (1)..(3168)
atggaggcggaggcggcggcagctcctgagcgggaaggcgggagctgcgtgctgtgctgcggagacctggaggccacggcgctggggccgctgcgaccacccggtgtgctaccgctgctctaccaagatgcgggtgctctgcgagcagcgctactgcgccgtgtgccgcgaggagctgcgccagctgctggctgtgggcacctggctggagcccgttggtttgctgagcttagagatttgtttgcttccagcattgtgaaattcccccggtttgttcatagaaggcttcggctggtgacatctgccaggaatctaactttcttctccccagaagtgatgcagagcagtattgaggcagacactggcttcctcgcccgcctgcctgctgcttcgggagctgtggtggggaagtggccctgtctggttcccgggagtccaggtactcagctccccgaggaggctcgcgctctgcgtcccagcagcaccctgagtggctccgctcagctccccgaggaggctcgtgctctgggtcccagcagcaccctgagtggctgcacagattgcgcctgtgagggtcgggctggagaggcgcccttgggagtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggtgagcaggcacctggcctggatgcccccaggcctgttcctcctattgtcgtcccggggtcccgggaagtgacgggctgtctgctggccgcaggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacacggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcctacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctgatttgggccctcccaaagctgagggctgcagcccgtggggcctcagagctgaaagctgcggcgccactggtgccagagtcagatgtcacagatgtgttgtgtaaacagttggctgtttcatgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcaaaaaaaaaaaaaa

SEQ ID NO: 234 - DNA, 677 bp, Homo sapiens
  CDS (293)..(571)
attgaaaccttgtggtaccgcctcggaattcccgggtcgacccacgcgtccgctcgcttcttacctcacataattcctgccttaaaatgtttaaaagtaggaaaagccctttgtttggggctcagactttctggacatatgtccagctgggccagtgatgaccttaatagactctcctgaaccttttttggtctctccagtctttgattgtcctgtaacatttctgggggcttatccgggattggagatggcagattttctgtcttctttgcctgtgggctagagccccaggatgtgggagatctggggtccttggcaccgctgggagagtttcagcctggaaggagaatggccctcccgcattccagagccttcccctgacagcaccaaaggaaccagtggaaagggttgcaggacagtcacaggagcagtgcacagacatctgaaccatgttgcaggtatcataccttgggttcttcatagccagctgaaaccaacagcagccactgcccaggaccagtggaccagtcaacaatacccagaccacccaacacggctgatcctacagtgaaatcaagccactgctgacaagaacaactgaacaactgccctgctccaaccacaccagaggctgggtcagtccacgcatggctgaagcttaaggaaacatcgagccc

SEQ ID NO: 235 - DNA, 1789 bp, Homo sapiens
  CDS (706)..(966)
ttggggtgtcacccaccattgaaaatgagttttttttttaacctgtaaaactaggctgattttgaattccagggctagtcctgagaattaagtgagagaatacatgtaaagtcgtgtaactggagaagttatatgcacttgctgggtatgactacaggactggcatttacggattgtttatagaggtctgggcattgggttatggtttgggatttgactgtcacttgacagccacggccgctgtgaatgacagaaatgaggttcttgacccttccttaccggtcagctgtatgcagtgtggtggtattgtcctagatgttttgcataacagacctgtcatcatacagatgaggaaactgaggctcagaaaggctaagccgcttaaccagaagtcacatagctactaagaccaagttaggttttgaatctagacttctgactcctaagctcaccagatcttaacctacttggaacccactgcttggtagtgaattataataaaatattaactgtgtttctaaccaaatcagtgcttgagatttaaaaattcatacacacgcctcaaacctacagattctgaaacgacttctttgggattaaagaagtgtatgtttctagaagactgcggaaaacatcatttctttggctgtgactttcttggagcaggcagtggtgagcaaggagtgtgtccccgtggaccagttcatggagcacctgcttcccagcctcctgagcctcgcatcagatcctgtgcccaacgtgagggttctgctagccaaggccctaaggcagatgctgttggaaaaggcgtattttagaaatgctggtaaccctcatcttgaagtcattgaagagaccatcttagcattgcagtcagaccgggaccaagatgtttccttttttgcagccctagaaccaaagcggcggaatatcatagacactgctgtactagaaaaacagaattaactacttccgtgatgagttgcaatctgattatttcatgcttggcacatatggcttaccataacttgaaggggaactgattgtattataccagctgggggagattttggaacctttcatactatgcactcagtgattgacgccttttccatctgtaccccgaagggactgaacctgatgggggctttttctggatggctgggccatcctgatcaagcctgatcagtaagtctgtggaaagattgcagaccaggtggctaactgggcactggagcctctgaaccatcaggctgtctgccagcaagttcttttctccatggcagactgtatgatctgaagtccccccaaccctctccaagtaaagtagtttattagaagctcttaagtctttaatagacctgcatatttccttcccttatgatttcctataaaatatagtttatggtgttatatttttaactgaaatactgtacatatgtaaataactcttgacaggaagaaaatatattaatgtagtatttgccccctatcagtgagctgaacaaatacatcatttaaatctatgctgcactttgagttgctacaaatatggttcgatttgtttatttttgaaaaatgtgataaagaaatctaaagaatgattgatggcagtctttctaatattgtgcctttgttataaactacttggaacttttcctcaggcactcactcctccctgcctgacaggaactgtttccatgaagatatgtgttggcctttgatagaggcataaagctgaaagatttttcatttttatatggatatgctgtcatatgtttaagaactg

SEQ ID NO: 236 - DNA, 1935 bp, Homo sapiens
  CDS (175)..(1872)
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgcccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggacccccccctccccgagtgtgcccaggaactcagagagggcgcggcccccggggattcccccccgagggtgcccaggactcggaaggggcgccccggactcgacaagctggaccccctgctcccggggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttactttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaa

SEQ ID NO: 237 - DNA, 6098 bp, Homo sapiens
  CDS (58)..(4251)
acgtcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggatgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtaacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaa

SEQ ID NO: 238 - DNA, 2007 bp, Homo sapiens
  CDS (1298)..(1804)
agattcggcacgaggaaatttctttactatctacactattctaccctaagatgccaatatctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcggagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaaaaaaaaaaaa

SEQ ID NO: 239 - DNA, 1408 bp, Homo sapiens
  CDS (401)..(1072)
tcgattacgccaagcttggcacgagggggctaatgaagcctagaccccagctggattggaagcaaaggcctttccttcactgggaaaggtgctgctgctacccatctcattattctaagagtgattgagaatagaggggctgaagggaaacgaaagtaggagaatgttggccagagctagtagagaaagaacgtaatattgagaaagcagacatcagtgctaggtgaggtgctttctttaaagagctgtgtgtatagactggggaggagtctgtctggggacaggaatgctgattcctttttttccctgggcagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccataagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctc

SEQ ID NO: 240 - DNA, 4953 bp, Homo sapiens
  CDS (1)..(4953)
atggcctgtgctgtggtttcagagaagcacaaggcaggaagcaagaggcatttagcacaggctcatggtgagatgctgtcaggtatcacctacattaagtttgtcaaagtccctggggaactggttactgcaaagatggctgaaataagagagcagtgtgtggcaggcccccgtggaggatcaacgcagtggctgaacaccgggaaggaactggcacttggagtctggacatttgaaacttgggagagaggctcaccacttttgagtccacggggcttgcacctccacaagacaaacatccctaggccacccagagtaggcaagagaggaggtgaagcctcgggagaaacccctcccttggcagctggtttaagacccaaaacggggatacaaatgcccctgagagagcagtggtatactggaatagatgaggatgggcacatggtggagaggcgtgtttttgtgtaccagcccttcttctctgccgacctcctcaactggaaaaacaataccccatcctatactgaaaagccgcaagctctaattgatttgctccaaactattatccagacccataaccccacttgggctgattgccaccagttgctcatgttcctctttaacacagatgaaaggcggagagtgctccaagcagcaactaagtggctagaggaacatgcaccggctgattaccaaaacccccaagagtatgtaaggacccagttaccgggaaccgacccccagtgggacccaaatgaaagagaggatatgcaaaggctaaaccgatacagggaagctctcttggaaggattaaagaggggagcccagaaggccacaaacgtggccattcagggaaaagaagaaagtccagcacaattctacgagaggctgtgtgaggcctattgtatgtatactccctttgatcccaatagtcctgaaaatcagcgcatgattaacatggctttagttagtcaaagtgcagaagacattagaagaaaactgcagaaacaggctgggtttgcagggatgaacacatcacagttattagaaatagctaaccaggtgtttgtaaacagggatgcagtaagccctaaggaaaaccgcagagagaatgaacatcaggtccggcgaaatgccgacctgttagctgcagcaatcacaggggtccccccaaagaggcaagggaaggggggccccgggaaagaaattcagcctggttgtcagagcttgcagcgtaatcagtgtgcttattgtaaagaaataggacattggaagaacaaatgccctcagctaaaaggaaaacaaggtgactcggagcaggaggatccagacaaggaggaaggggccctgctcaacctggcagaaaggacccccaaagagcctatggtcaggatgacagttgggggtaaagacattgattttcttgtagataccggtgctgaacattcggtagtaaccaccccggtcagccccttatccaaaaagactattgacataattggagccacaggagtttcagcaaaacaagctttctgcttgccccggacttgtactgtaggaggacataaagtgattcatcagtttttgtacatgcctgattgtcccttgcccttgttgggaagggacttgcttagcaaactgagagccactatctattttacagagcatggctctttgctgctaaagttacccggaacgggagtcattatgacccttatggtaccccgagaggaggaatggaaacttttcttaactgagtcgggccaagagataagaccagctctggctaagtggtggccaagagtgtgggcagaagacaaccctccagggttggcagtcaaccaagcccccgtacttatagaagttaagcctagggcccagccggttaggcaaaaacagtacccggtccccagagaagctcttcaaggtatccaggtccatctcaagtgcctaagaacctttggaattatagttccttgtcagtctccatggaacactcccctcctgcctgttcccaagcctgggaccaaggactacaggccggtacaggatttgcgcttggttaatcaggctacagtgactttacacccaacagtacctaactggtacacattgctggggttgctgccagctgaggacagctggttcacctgcttggacctgaaagatgctttctttagcatcagattagcccctgagagccagaagctgtttgcctttcagtgggaagatccggagtcaggtgtcactactcagtacacttggatccggcttcccaaagggttcaagaactcccccaccatcttcggggaggcattggctcaagacctccagaagtttcccaccagagacctaggctgcatgttgctccagtacgttgatgacctttttctgggacaccctacggcagtcaggtgcgccaagggaacagatgctctactccggcacctggaggactgtgggtataaggtgttcaagaaaaaagttcagatctgccgacagcaggtacgttacttgggatttactatccggcagggggagtgcagcctgggatcaaaaagaaagcaagtcatttgtaatctaccggagcctaagaccagaaggcagagccctgtcaagcatgactgtgtagaagtgttggactcagtttactctagcagacctgacctccgggaccagccttgggcatcagtagactgggtactatacgtggatgggagcagcttcatcaacccacaaggagagagatgtgcagggtatgcggtggtaactctggacactgttgttgaagcccgatcgttgccccagggcacttcagctcagaaaactgaactcattgctttaatttgggccttagaactcagtgaagcacctgatcttgtacctacttattctaaagaagaaaatgactttctccaggcagagggaggacaagtgatggaggaaggattgattcggttaccagatgggagagtagctgtgccacagctgctaggagctgcagttgtactggctgtccatgaaaccacccatctaggtcaggaatcacttgaaaagttgttaggctggtatttctacatctcgcatttgtcagcccttgccaaaacggtgacccagcggtgtgttacctgccgacagcataatgcgaggcaaggtctagctgttccacctggcatacaagcttatggagaagccccctttgaagatctggatccaggtggacttcacagagatgccaaagtgtggagatttggactgcctttatggatcggctcagataacgggccggcatttgtggctgacttggtacagaagatggcaaaggtattggggatcacatggaaactgcatgctgcctaccggcctcagagttccggaaaggtggagcagatgaatcggactatcaaaaatagtttagggaaaaacaaaaaggacccagtttatcttcagaagggggaagccaacccctcctgtgctgccggtcactgtaacccactagaactaataattaccaatcccctagatccccgttggaaaaacggagaacgtgtaaccctggggattgatgggacagggttaaacccccaagttgccattttaattagaggggaggtccccaagcgctctcccaaaccagtatttcaaaccttttatgaggagctgaatctgccagcaccagaacttccaaaaaagacaaaaaatttgtttctccaattagcagaaaatgtagctcattcccttaaagttacttcttgttatgtatgcgggggaaccactatcggagaccgatggccttgggaagcccgagagttggtgcctactgatccagctcctgacataattccagttcagaaggcccaagctagcaacttctgggtcttaaaaacctcaattattggacaatactgtatagctagagaagggaaagactttatcatccctgtaggaaagcttaattgtataggacagaagttgtataacagcacaacaaagacaattacttgttggggcctaaaccacactgaaaagaatccatttagtaaattttctaagttaaaaactgcttgggctcatccagaatctcatcaggactggatggctcccgctggactatactggatatgtgggcacagagcctatattcggttacctgataaatgggcaggcagttgtgttattggcactattaagctgtgctttttcttattacccataaaaacgggtgagctcctaggtttccccatctatgcctcccaagaaaagagaggcatagttataggaaactggaaagataatgagtggccccctgaaaggatcatacagtattatgggcctgccacatgggcacaagacggctcatggggataccgaacccccatctacatgctcaatcggatcatacggttgcaggccatcttaaaaataattactaatgaaactggcagagctttgactgttttggcttggcaagaaacccaaatgaggaatgctatctatcagaatagactggccttggactacttgctagcagctgaaggaggagtttgtggaaactttaacttaaccaattgctgcctacaaatagatgatcaaggacaggtggttgaaaacatagtcagggacatgacaaaggtggcacatgtgcctgtacagattaaactgtacacgagtttaatcctgagtctttatttggaaaatggtttccagctatgggaggatttaaaaccctcattaagtacatctaactgtcctaagaataaagataaggatgaagaccaatctgaactgcttactgctgacagagggggctgttttggggaaatggcagtcagaactccctcagaggcctatctaaaggttcccagcagaagaagccatcgtccaaagctccggttgaatgactgtttggagtttgatggcctgaaggcaagaacagacaaactgggctattag

SEQ ID NO: 241 - DNA, 844 bp, Homo sapiens
  CDS (10)..(705)
atctattcgatgatgaagataccccaccaaacccaaaaaaagagatctctcgaggatccgaattcgcggccgcgtcgacctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaaaaaaaaaaaa

SEQ ID NO: 242 - DNA, 2753 bp, Homo sapiens
  CDS (416)..(2353)
  misc_feature (1)...(2753): n = a,t,c or g
ccgagccgagcgccgaggaccgtgctaccccaggcccgggctcgcccagcgcaggctcctctctggcagcagcggcggcgcggngaccccngtccctcggcctccnnttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaaaaaaaa

SEQ ID NO: 243 - DNA, 4468 bp, Homo sapiens
  CDS (249)..(1940)
atttggccctcgaggccaagaattcggcacgagctcattgtgtctgtgtcgaggcgtcgggagggcctaagtccgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacaaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaa

SEQ ID NO: 244 - DNA, 461 bp, Homo sapiens
  CDS (47)..(274)
atttggccctcgaggccaagaattcggcacgagggacagatgcctcatgttgaagcaggggtctcaacctggctcacctccagcaacattgagcctccagcacctcctgtctaccaagccccgtgccagtcctgcccagaacccccaggagcccatgagccctctgactctccacaccataccccagtccatcctcctccagagcactcggccgcctgtcctgccccagccacgtgctgtccgcccccgagaagctctatgtcataaatcttaactcagatgggagagggagcctcagagtcacatagccctgggcccaaaccccagctcctccacccaagtactgatggtcaggttcttcagcctcagtttctgtagctgtaagatggggagaatgatctctgggagggttaaatgtgcggcaaaatggccaagagttgggctctgggactaggaccatg

SEQ ID NO: 245 - DNA, 5532 bp, Homo sapiens
  CDS (534)..(4262)
cattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggggaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatgggaatcctgcaaaacctggcagctatgtatggaggcaggcccagctcttcaagaggagggaagccaagaaacaaagaggaagaggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattaaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcaatgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctacacattttgaagatgaaatttttagccttaaagtttatattctcaagtccttttacaatcagtgtgtcacctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactgtatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctaaaaaaaaaaaaaaaaaaaaaaactgcggccgcaagctta

SEQ ID NO: 246 - DNA, 5448 bp, Homo sapiens
  CDS (534)..(4178)
cattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggggaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattaaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcaatgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctacacattttgaagatgaaatttttagccttaaagtttatattctcaagtccttttacaatcagtgtgtcacctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactgtatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctaaaaaaaaaaaaaaaaaaaaaaactgcggccgcaagctta

SEQ ID NO: 247 - DNA, 1767 bp, Homo sapiens
  CDS (1)..(1767)
atgactactcagttgccagcttacgtggcaattttgcttttctatgtctcaagagccagctgccaggacactttcactgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccagaagatgctatttatggctggaacttcaacagggactctctctacccatatttggaggacatcccagaccctgaagtaaactggatcccctgtaataatcgtaacagggacatggataaagctggaaaccatcattctcagcaaactaacacaggaacagaaaacaaaacactgcatgttctcgctcataagtgggagttgaacaacgagaatacatggacacaaggaggggaacatcacacaccggggcctgtcggggagtcgggggctaagggagggatggcattaggagaaatacctaatgtagatgatgggttgatcttagagaaaagctttcagttttccctcattcagtatgataccagccatgggtctgtcataaatggctattattgtgttgagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataagcaaaaccttttcatgggtgaaaatcaattcaatgtacccaaggagcctgagattgtgactttcaataccacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcagtgctgtgatgatggacaattacatagtaccgataacagccatgcactgtgcaaagcatgcccttctgcacaggagagcaaggcacttgcagtagtgatctatgccagcaaaacatcattttga

SEQ ID NO: 248 - DNA, 7453 bp, Homo sapiens
  CDS (1)..(4362)
atggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaagaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacaaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcaagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccctgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagataaaaaaaaaaaa

SEQ ID NO: 249 - DNA, 7501 bp, Homo sapiens
  CDS (1)..(4410)
atggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctcaggaatcgcctaaaccagtgaaacaccagagtggatccctgttgtatggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaagaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacaaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcaagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccctgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagataaaaaaaaaaaa

SEQ ID NO: 250 - DNA, 1163 bp, Homo sapiens
  CDS (258)..(671)
gaggatgatgtatataactatctattcgatgatgaagataccccaccaaacccaaaaaaagagatctctcgaggatccgaattcgcggccgcgtcgaccggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcaaatgtgtcctggtttcggcagcgtaaccagctgctgcttgaggccatggcttcgtcccggagttggcggtaccg

SEQ ID NO: 251 - DNA, 7269 bp, Homo sapiens
  CDS (73)..(3162)
aagctggtacgcctgcaggtaccggtccggaattcccgggtcgacgatttcgtaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttataaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctatataaagattatatagttgcaaacaaaggttgtgaaatttcccttttgttgtttttgacttttaattaataaaagtacattgttttcatagcaaaaaaaaaaaa

SEQ ID NO: 252 - DNA, 7092 bp, Homo sapiens
  CDS (73)..(2985)
aagctggtacgcctgcaggtaccggtccggaattcccgggtcgacgatttcgtaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgattgttgaccttttataatcttctgtaggctatctttcaaacactggcatcagaatattttttataagtttgtgtttaaacagcttagttggtccccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttataaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactccaatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacatgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctatataaagattatatagttgcaaacaaaggttgtgaaatttcccttttgttgtttttgacttttaattaataaaagtacattgttttcatagcaaaaaaaaaaaa

SEQ ID NO: 253 - DNA, 5574 bp, Homo sapiens
  CDS (123)..(4529)
gctgtcggtaccggtccggaattcccgggtcgacgatttcgtattggctttcaggctggcgcctgtctcggcccccgcgccagttttgggctggttggcgcggaatcgggagattcgggaccatggcacctgtgcacggcgacgactgtgagataggggcgagtgctctgtcagattcagggagttttgtatcttctcgagcccggcgagaaaaaaaatcaaagaaggggcgccaagaagccctagaaagactgaaaaaggctaaagctggtgagaggtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaaagtccacagctcttaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaaggagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaaaaaaaaaaa

SEQ ID NO: 254 - DNA, 1127 bp, Homo sapiens
  CDS (147)..(995)
ggcacgaggtcgaggtgaagagcaatttgacgccgagttccgacgcttcggctgcctccgcttcggtgagcggcttccaggagttctcgcggttgctgcgggcggtgcaccagatccgggcctggacgtgctacttggctatacggatgctcatggcgacctgctgcccctcaccaacgacgacagcctgcaccgggccctggcagcgggccccgccactgcgcctactggtgcagaagcgggaagctgactccagcggcctggcttttgcctccaactctctgcagcggcgcaagaaagggctcttgctgcggccagtggcacccctgcgcacccggccacccttgctaatcagcctgccccaagatttccgccaggtttcctcagtcatagacgtggacctactgcctgagacccaccgacgggtgcggctgcacaagcatggttcagaccgccccctgggcttctacatccgagatggcatgagcgtgcgtgtggctccccagggcctggagcgggttccaggaatcttcatctcccgcctggtacgtgggggtctggctgagagtacagggctgctggcggtcagtgatgagatcctcgaggtcaatggcattgaagtagccgggaagaccttggaccaagtgacggacatgatggttgccaacagccataacctcattgtcactgtcaagcccgccaaccagcgcaataacgtggtgcgaggggcatctgggcgtttgacaggtcctccctctgcagggcctgggcctgctgagcctgatagtgacgatgacagcagtgacctggtcattgagaaccgccagcctcccagttccaatgggctgtctcaggggcccccgtgctgggacctgcaccctggctgccgacatcctggtacccgcagctctctgccctccctggatgaccaggagcaggccagttctggctgggggagtcgcattcgaggagatggtagtggcttcagcctctgacagtcaggatgaagccccatgccactccacactgctgggacatggcagggacttcacagtgggggtttttagctggctcacagggctccctcagcctggggaacattaaaggttttctacaaaaaaaaaaaa

SEQ ID NO: 255 - DNA, 6470 bp, Homo sapiens
  CDS (118)..(1653)
attgaacgcctgcagtaccggtccggaattcccgggtcgacccacgcgtccggctcatcataacttatgttccatattttttaacccacatcactcttgaaatcgactgttcagttgatgtgcaggcttttacaggataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcgggtcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacgtagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgttttttgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagtttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgtcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctgg

SEQ ID NO: 256 - DNA, 1997 bp, Homo sapiens
  CDS (479)..(1882)
ttttttttttttctatttattttaaatacacacacccagagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcaccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaatgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctactccctaaggttgacaattgatgctgagtgccaattacaattgcacaattttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataagtatctgaatctgtttc

SEQ ID NO: 257 - DNA, 2215 bp, Homo sapiens
  CDS (72)..(1430)
atttggccctcgaggccaagaattcggcacgagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctccgcctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaatttt

SEQ ID NO: 258 - DNA, 2074 bp, Homo sapiens
  CDS (169)..(585)
tttgaattctgagagcgtacgacggccctaccggaccggaattcccgggtcgacgatttcgtccgccatcaccacccgcacccgttccgggtttcgtgcctgcccgcagcccaccaccaggtgcgctggcgcgcggacggcccttccctggagaagctgcctgtgcacatgggcctggtgatcaccgaggtggagcaggaacccagcttctcggacatcgagagcctcgtggtgtggtgtatggccgtgggcatctcctacattagcgtctacgaccaccaaggtattttcaaaagaaataattccagattgatggatggaattttaaaacaacagcaagaacttctgggcctagattgttcaaaatgctcaccagagtttgcaaatagtaatgacaaagatgatcaagttttaaattgccatttggcagtgaaggtgctatccccggaagatggaaaagcagatattgtgagagccgctcaggacttttgccagttagtagcccagaagcaaaggagacccaaagatttggatgtagatatgttagtttactcagttcaaatggttgtcctgatcctgatttagtactgaagttcggtcctgtggacagcacacgaggctttcttacctggcacatcagattgactgagattgtctctttgccttcccatctaaacatcagttatgaggactttttctctgcccttcgtcattatgcagcctgtgaacagcgtctgggaaagtcgtggtcattggttgcataattccatttgagcttatggaggaaaggaccaagtgactctgattttagaaagcacctatgaaaccctgtacacacctatgaaaccctgtacacacctagttcataatcttcataatttatcaacaaacacaaaaaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgatggattctaggtaggaaccattcttata

SEQ ID NO: 259 - DNA, 7313 bp, Homo sapiens
  CDS (13)..(6147)
cgtggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcccggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacacttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaacgtccgcctcccgggttcacaccattctcctgcctcagcctcctgagtagctgggactataggcccccgccaccatgcctagctaatttttttgtatttttagtagagacagggtttcaccgtgttagccaggctggtctcgatctcctgacctcgtgatctgcccgccttggcctcccaaagtgctgggattacaggcatgagcaccacacctggcccatgtccacatattctaaacatcagaaaacaacaaatacattgtagttctgttcaaatttctacttctaaagttatgtgtgcaactagggacacactgagatttatggagaaaaggataaaagcaaagatttaaaattacatgctagacttagtaacata

SEQ ID NO: 260 - DNA, 5473 bp, Homo sapiens
  CDS (1)..(4482)
atgagaatagcacaggaaagacccaccgccatgagtaaaggaattgtgggagtgatggtgtttgtacatgctcgaaatgccactgtaagaacagctatgtctctaatagaaagagcaaaaaattgtggccatattcccttcttttttcctacccaaggacatgactatgtacttgcagaaaaacaggtacaaaggtcgagaaataagcaagtacgagaattattcccagatggttttagtattcatcatgcaggaatgcttcggcaggacagaaatttagttgaaaacttgttttctaatgggcatatcaaagtcctagtgtgtacagctacgttagcctggggtgtcaatcttcccgcccatgctgttattattaagggaacacaaatatatgctgcaaaaagaggctcctttgttgaccttggaattttagatgtcatgcagatatttggtcgagctggacgaccacaatttgacaaatttggggaaggaataattataacaacgcatgataaactcagccattacctcactttgctcactcaacgaaacccaattgagagtcagtttctggaaagccttgcagataacctaaatgcagagattgctctgggaacagttactaatgtggaagaagcagtgaagtggataagttacacttatctttatgtacggatgagagcaaatccattagcatatggcatcagtcacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcattcattcagcctatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattgtaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacttccatcgagtgccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagtgactgctaccttggcctggaccagcagtatgacaatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaagctgactcaatgttttctttctgcttccctttaaataatatccccttactcatctgttcttcttttctttcccttctacttcaaggctttatttctattatctttctgacatatttatttacagaagtagagaagtataatctaattcatgttgtagcacttacagatcatatagtacaattatttgtctttatgctctccaggaaaaatctgagacagaaaatttttcacccctatggataggatttcgcctgtaataaagaaaatttctaaatgtccaaacaaaaaaaaaaacaaaaaaaaaaa

SEQ ID NO: 261 - DNA, 2392 bp, Homo sapiens
  CDS (49)..(2274)
atttggccctcgaggccaagaattcggcacgagagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatatttggaaagctgttgggtccattgcccatgcatctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaggccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacaaaaaaaaaaaa

SEQ ID NO: 262 - DNA, 5006 bp, Homo sapiens
  CDS (464)..(3427)
tcagtgtggtggaattccacagagtatatcagtcctatccagctcattaccgatgaatgtgagaataacttacatggctaatagtagtagagtatctctcctgggtttttcttttcttcaagtgcttatagctaaatacattctgggaacacttagaacttgctaattcagtattgctacttttacagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcaaaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtatatatcaaaaaaaaagtcgatcggccgcgaagttagtagtagtagcgacagctctagaggatccaagcttacgtacgcgtgcatgcgacgtcattagctcttctatagtgtcacctaaattcaattgacgagatg

SEQ ID NO: 263 - DNA, 1878 bp, Homo sapiens
  CDS (616)..(1686)
  misc_feature (1)...(1878): n = a,t,c or g
agcctgnggggnnnnaaatcgagagcacttcnagngngcnggaattcgtggattcctggctccagaaaatgggcttggagcgggggccacgttgaggaaggcgaagggcattgtgggggcgttatgtaaaagtaggaccccaaccgacagatcctattgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaaaaaaaaaaaaaaaacgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgcccagatgcagatcctgaagtttttggtcaataggctctgtcttcgtgagagacgggctgagagtcagaaataaatcaaccatttgtggtttaaaaaaaaaaaa

SEQ ID NO: 264 - DNA, 2562 bp, Homo sapiens
  CDS (259)..(1770)
ttttgtcctaaaaacagaaaatagccgcattcacataaactctgatagggtcctgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggagctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaaaaaaaaaaaa

SEQ ID NO: 265 - DNA, 1617 bp, Homo sapiens
  CDS (237)..(1502)
agggatgatcggcatgaggcattcgcctattgaggctctataaaacacgtctgtacaaaaaagcaggctggtaccggtccggaattcccgggatctattgcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaaaaaaaaaa

SEQ ID NO: 266 - DNA, 4549 bp, Homo sapiens
  CDS (186)..(3362)
caatctagtttcaacatacaatgaggatttctgtctgatacagagaaagatacccagtgtctggagggtctgtcttaagaagtgctcttgaagtctgctgggatttcctttcgggactcacagagggaagcctgctccctgagggctttttctcaggcccaatagatcagggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgctttgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttggacggtgtggccattttattcctacagccctagacggctaggtgagccccaaggacgggtggggtgctggctgcagggggcggggacacgcctttatcttgaaaactgtcatgggatggcattatttgttatttcacctgatcatatttttattttaaaacttcagttacataaaagttttaaatgctttttttaagcctacaccgtttgtaacatctccatagaaacttggaaatcaa

SEQ ID NO: 267 - DNA, 4942 bp, Homo sapiens
  CDS (186)..(3755)
caatctagtttcaacatacaatgaggatttctgtctgatacagagaaagatacccagtgtctggagggtctgtcttaagaagtgctcttgaagtctgctgggatttcctttcgggactcacagagggaagcctgctccctgagggctttttctcaggcccaatagatcagggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgctttgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttggacggtgtggccattttattcctacagccctagacggctaggtgagccccaaggacgggtggggtgctggctgcagggggcggggacacgcctttatcttgaaaactgtcatgggatggcattatttgttatttcacctgatcatatttttattttaaaacttcagttacataaaagttttaaatgctttttttaagcctacaccgtttgtaacatctccatagaaacttggaaatcaa

SEQ ID NO: 268 - DNA, 1301 bp, Homo sapiens
  CDS (162)..(935)
taagcttgcggccgccaactttttttttttttcaatgaacatgacttctggagtcaaggttgttgggccattccccccgttccactcactgggaatataaatagcacccacagcgcagaacacagagccagagagctggaagtgagagcagatccctaaccatgagcaccagccaaccaggggcctgcccatgccagggagctgcaagccgccccgccattctctacgcacttctgagctccagcctcaaggctgtcccccgaccccgtagccgctgcctatgtaggcagcaccggcccgtccagctatgtgcacctcatcgcacctgccgggaggccttggatgttctggccaagacagtggccttcctcaggaacctgccatccttctggcagctgcctccccaggaccagcggcggctgctgcagggttgctggggccccctcttcctgcttgggttggcccaagatgctgtgacctttgaggtggctgaggccccggtgcccagcatactcaagaagattctgctggaggagcccagcagcagtggaggcagtggccaactgccagacagaccccagccctccctggctgcggtgcagtggcttcaatgctgtctggagtccttctggagcctggagcttagccccaaggaatatgcctgcctgaaagggaccatcctcttcaaccccgatgtgccaggcctccaagccgcctcccacattgggcacctgcagcaggaggctcactgggtgctgtgtgaagtcctggaaccctggtgcccagcagcccaaggccgcctgacccgtgtcctcctcacggcctccaccctcaagtccattccgaccagcctgcttggggacctcttctttcgccctatcattggagatgttgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgctccagctgcctgggaggcttttggtggtccccacagcctctgggccaagactcctgtcccttcttgggatgagaatgaaagcttaggctgcttattggaccagaagtcctatcgactttatacagaactgaattaagttattgatttttgtaataaaaggtatgaaacaaaaaaaaaaaa

SEQ ID NO: 269 - DNA, 6256 bp, Homo sapiens
  CDS (257)..(5443)
cagtgaaggatgaagaatgattagactctaaggattatgtgtaataatccgggagacatagatgtgccatctcatgaattaaattgttcacttctttcagagacttgtgttactattggagaaaagaaaaatgaagctttgatggaatgtaaagccaagcctgttggtagtccaattgtttaagttttcagataaagaagaacatgaacaaaatgattccatttcaggtaaaacgggtgagactggtgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaaaaaaaaaaaa

SEQ ID NO: 270 - DNA, 4125 bp, Homo sapiens
  CDS (546)..(3089)
  misc_feature (1)...(4125): n = a,t,c or g
cataggccaacaataaatgaataggtcatcttagcacccagttttcacttatcttcggctgtatgttgttggattggacggaaaccatttccacagaacagttatgacagattcgaattaaaacgctcactataggaattggccttcgaggccagatcgggcacgagggggagagggccttaaaggtggcgtccgctgttagaaacacttggcgcaggtaaaggggtggcggcgagaggaggttcccacccgtggctttcttagagaaatgaagtcttaagtcttaaatagacaacaaggagggccgatcggtgtcntttggacgcgtctggngcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattgttgtaatgtgaccttttcactgtgcaaagggagatttctagccaggcattgactattacaatttcattttggtggagtttagttttaggttttattgtatataagatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttaatttccatatgggctaagaatcagaatatttgaaatctgtctggctttctccctcataagtgagg

SEQ ID NO: 271 - DNA, 1865 bp, Homo sapiens
  CDS (107)..(1558)
gaaagaaattgagatggtgcacgatgcacagttgaagtgaacttgcggggtttttcagtatctacgattcatagatctggaattcgcggccgcgtcgacccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaattgtcatctggactcattgtgggacttggggattagaggacctgagacaaagatgctgctgccctactgcttgctaacgaagctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaattctcagttttaaaaactgctttcttattgctgcaaaatatttttcaacatttgtttttctatgtagttgattctcaacctttccccaccacccccctaccatgctcgtgccgaattcttggcctcgagggccaaat

SEQ ID NO: 272 - DNA, 2495 bp, Homo sapiens
  CDS (411)..(812)
cgcggaattcgtgctccgcctccggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactggtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaaaaaaaa

SEQ ID NO: 273 - DNA, 2362 bp, Homo sapiens
  CDS (62)..(2128)
cgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgtgggcacccatgggtacatggctcccgaggtgctgcagaaggggacggcctatgacagcagtgccgactggttctccctgggctgcatgcttttcaaacttctgagagggcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacaaaaaaaaaaaaaaa

SEQ ID NO: 274 - DNA, 1829 bp, Homo sapiens
  CDS (146)..(1390)
attacgccaagcttggcacgaggcgtttgtcccttgcggtacccgacttaataccaatgtagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaagggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactcaaaaaaaaaaaa

SEQ ID NO: 275 - DNA, 1708 bp, Homo sapiens
  CDS (36)..(1571)
gcacaggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctacaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagtgtggaagctctaaatttgaaactgtacttaataaaaatttttttgtataaaaaaaaaaaa

SEQ ID NO: 276 - DNA, 1582 bp, Homo sapiens
  CDS (132)..(1052)
ccactttgtacaagaaagctgggtacgcgtaagcttgggcccctcgagggatactctagagcggccgctcgcgatctagagccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacagtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactattatttcattgtgttctacttaagagaattatcaagcatcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttcttttattttgcctgaaatcctactcgttgacatttgagattttaagctttgtggctgaaaatatatagatctctgagaaaaaaaaaaaa

SEQ ID NO: 277 - DNA, 3146 bp, Homo sapiens
  CDS (23)..(3130)
taagcttgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaaggaccagttggcacctgctatgtagcaattcagaacttcagcgcttatgccgagttctctccttgcggaaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactcctacgatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggctacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagcaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaaaaa

SEQ ID NO: 278 - DNA, 3524 bp, Homo sapiens
  CDS (184)..(1545)
taagcttgcggccgccaattttttttttttttttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgcaaaaaaaaaaaa

SEQ ID NO: 279 - DNA, 3073 bp, Homo sapiens
  CDS (130)..(2037)
  misc_feature (1)...(3073): n = a,t,c or g
ttgaaanctagtaagtcgtacgcctgcggtaccggtccggaannnggggtcgacgatttcgtctggagcgatggaggaccccggccccggcgcggtccagcggtgggagcggacgatttcgtgcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctggaaaaaaaaaaaaaaaaaaaaaaaagggggggccccttttaaaaaaaccaattttacccccccgggctggcaaaataaaattttttttaaggggcccccaaaaaaaaatcccgggccccggttttaaaaacgggggaaggggaaaaacccgggggacccccaaaaaaacccccttgaaaaaaaaa

SEQ ID NO: 280 - DNA, 3937 bp, Homo sapiens
  CDS (334)..(3246)
atcggaactcggaatgccgttataactatctattcgatgatgaagataccccaccaaacccaaaaaaagagatctctcgaggatccgaattcgcggccgcgtcgaccggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccaacttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagatagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttacataaaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgttaaatacattgtttctctattatctgaaaaaaaaaaaa

SEQ ID NO: 281 - DNA, 4382 bp, Homo sapiens
  CDS (92)..(2476)
ggtaccggtccggaattcccgggtcgacgatttcgtgcctgtcggctgacgtgtctgcagttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtcgagtaaacattgttgatctacaacaggtaattaatgtggacctgattcatattgaaaatagaattggtgacattattaaatcagaaaagcatgttcagttagtgttgggacaactgatagatgagaattatttggatcggttggcagaagaggtcaatgataaattgcaagaaagtggtcaggtcaccatatcagaactgtgtaaaacttatgatcttcctgggaactttctgacacaggcactaactcagcgacttggtagaattatcagtggacatattgatcttgataatagaggagtaatttttacggaagcttttgtagctcgacataaagcacgtatccgtggactattcagtgctattacccggcctacagctgtgaattctttgatttcaaaatatggatttcaggagcagcttctttactctgtgcttgaggaacttgttaatagcggacgcttacgaggcactgtggttggtgggagacaggataaagctgtgtttgtccctgacatctactccaggacacagagtacttgggtggattcctttttcaggcagaatggctatctagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcacctctgctacccacttctttatcagttgaagatgctgccatattgcttcagcaggtgatgagggcattcagcaaacaggcctcaactgtagtctttagcgacactgttgtagtcagtgaaaaatttataaatgactgtacagaactgttccgtgagctgatgcaccagaaagctgaaaaggaaatgaaaaataatcctgtgcatttaatcactgaagaagatctgaaacaaatctccactttagaaagcgttagtacaagtaaaaaaaaaaaaaaaaatgagcgaagaaggaaagcaacagagggcagtggaagcatgagaggaggaggtgggggcaatgccagagagtacaaaattaaaaaagtcaagaagaaaggaagaaaagatgatgatagtgatgatgaatctcaatcatcccacactggaaagaagaagccagagatcagttttatgttccaggatgagattgaagattttttaagaaaacacatacaagatgcccctgaggagtttatttcggaacttgctgagtacttaataaaacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcagatgacacacaggctgctcttaccaaacacttgctgaagtcagtgtgtactgatatcactaacctcattttcaacttcttagcttcggatttaatgatggcagtagacgatcctgcagccattacaagtgaaataagaaagaaaattttaagtaaattatcagaagaaaccaaagtagctcttacaaaactccataactctctgaatgaaaagagcatagaagattttatttcttgtctggattctgcagcagaagcttgtgatattatggtgaaaaggggagacaaaaaaagggaaagacagatactgttccaacatcgacaagcactggctgaacagctaaaggtcacagaagaccctgctcttattctgcacctcacatcagtcctgttgtttcagttttcaacccacagcatgctccatgcacctggaagatgtgtcccacagatcattgcttttcttaatagtaaaattccagaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttacaaaaaagaaaaattattactaagcccttgctcttatttttggcagaataaacattgattttggttggggctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaattaaatttcaaatatttaaaaatactattttatataattccttatgacattttaaactttatattttaaaatatttgaatacgaaaagatcagtctacctctactccattctagacaaagtattaatccttagtgaaagtaattaattaaattgccaacttggcattattattaaacttgataggaacgcaacattaaatttaaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgtttactgtgatcttaatgggcagggttaagaaagttatttaaaataaagttacctattctactaaattttatagtactttgaagcttctattaattaacacaaagattaattggtgcatatattttatatatatacattttgaattctcattttgaacattattaaaggattttatttttcttacacaaaaaaaaaaaa

SEQ ID NO: 282 - DNA, 2230 bp, Homo sapiens
  CDS (85)..(1152)
gtaggcagggactgggttctactgtgagctgagatccctggagctccatgaaaaggagaaaagaatgccgtgtttcctggatctatggagggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggcgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctgaaaaaaaaaaaa

SEQ ID NO: 283 - DNA, 2663 bp, Homo sapiens
  CDS (115)..(2157)
cggaattcccgggtcgacgatttcgtcgcggccggctgagtcctctccagccgcgagaggcgtttctccatccgcggctcgcgcgctcgctctgagcccccgcgcccaggtgggatggaagaagcctgtcaggtgcagacaactaagcgaggggatcctcatgagttaagaaacatatttctacagtatgccagtactgaggttgatggagagcgttacatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaagttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagagcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtaaaaaaaaaaaa

SEQ ID NO: 284 - DNA, 1725 bp, Homo sapiens
  CDS (1)..(1488)
atggtaacgtggctttacagatttttacccacttcaaatatggccgccaagctccgttctcttttaccgcctgatctacggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacaaaaaaaaaaaa

SEQ ID NO: 285 - DNA, 3197 bp, Homo sapiens
  CDS (176)..(1933)
ggagcataatgctaaagaagtaaacaggtcatggcacgtttaacaaaaagacgacaggcgatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttggtgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcattt

SEQ ID NO: 286 - DNA, 3035 bp, Homo sapiens
  CDS (176)..(1771)
ggagcataatgctaaagaagtaaacaggtcatggcacgtttaacaaaaagacgacaggcgatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttggtgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcattt

SEQ ID NO: 287 - DNA, 1684 bp, Homo sapiens
  CDS (314)..(1357)
tttgatagacagtcgcctgaggtaccggtccggaattcccgggtcgacgatttcgtccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccg

SEQ ID NO: 288 - DNA, 1535 bp, Homo sapiens
  CDS (290)..(1036)
cccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtcaggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatagcagcacccaagtgtctgtgcacaggagtcagagagggggaaccgccgttccaacatcacaattagtgaatgaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaataatcaagcaagcaggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcgtgattagaaatgtttgttattggaaatgttacaccatgtaaataaaggaaatagattttagtattgtattcattttatattatagaactgcataatgtctgcagaataaaattaaaactaacaaatatgtcattagcagctgccctccgcatactttggaatctgacttgagataagcatgtgaaaatggttgagggccatagggaaccagatggtaaatacattcttcaaaattgaaaaaa

SEQ ID NO: 289 - DNA, 6775 bp, Homo sapiens
  CDS (197)..(4471)
ccgaattcccggttcgacgatttcgtggcggcaaaatggcggaccgcttctcccgcttcaacgaagaccgagactttcatgttaatcactttgatcactatgaggaaggacacttggaaattgaacaagcgtcacttgacaagcctatataatcgggagaacagatcccattccaatcgttgccaagtatgatgtcatgggcatgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacgcgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtggaaacttaaaaaaaaaaaaaa

SEQ ID NO: 290 - DNA, 2523 bp, Homo sapiens
  CDS (81)..(2138)
gtcctttttcccgggtcgcacccacgcgtccgcccacgcgttcgggaaaataaagctttttatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaaaaaaaaaaaa

SEQ ID NO: 291 - DNA, 467 bp, Homo sapiens
  CDS (223)..(465)
ctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgcgctgatgggaacctgcctcctggagacctcggggttttctctgaacttggaaacgtgtcccggtgtgaaagggtaatt

SEQ ID NO: 292 - DNA, 3570 bp, Homo sapiens
  CDS (162)..(2012)
gtcgactacaaggtggctacgagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaataccaaaaaaaaaaaaa

SEQ ID NO: 293 - DNA, 4503 bp, Homo sapiens
  CDS (233)..(2305)
  misc_feature (1)...(4503): n = a,t,c or g
tccggtccccctccctcagacgcgctgctcctgctccagatgaggtgatggcaacgccaacttcggcaagatccagatcgggatttacgtggagatcaagcgcagtcgggatagagtcttattctgtctcccagactggagtgcaatggtgtgatgtcggttcactgcaacctctgcctcctgggctcaactgatcctccccgctcagcctcccaagtagctgggactacagatgcacaccacatccggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaataagttttagagataatttacttcagtcacctttgttttggaaaggactcaggttttcttgcagctgtaagatatattctatttgtgtttatttcaaagggaagaggaaggatggacaactgttacaattgaccttgcaaaggatatttaaaaaaaaggtagtttttgagattaaccaactttcaaagggcaataaagacatgtgaatttgctcattttaaagcacaacagatgattagcttcaaatttattatttgcattggatgggtactgtctttggaaagtctccttatagacaaatatgctgccttacactatgatggcttcattctgatcaggtattttaaaaattagtaccagaaaagatactggaggtaatataatacagtccttcagctttacagatagtgaaaactgaaggccagaaaaggaactaaaactcagcagttcataggggtagagggaaataacctgagaaagccgagttaaatcttaaaatttttactataaggntagagatgatacaagtgaactctgcaaaatagttttgtgaaattaaacaaaaaaatctactcttaatgtatat

SEQ ID NO: 294 - DNA, 4617 bp, Homo sapiens
  CDS (233)..(2419)
  misc_feature (1)...(4617): n = a,t,c or g
tccggtccccctccctcagacgcgctgctcctgctccagatgaggtgatggcaacgccaacttcggcaagatccagatcgggatttacgtggagatcaagcgcagtcgggatagagtcttattctgtctcccagactggagtgcaatggtgtgatgtcggttcactgcaacctctgcctcctgggctcaactgatcctccccgctcagcctcccaagtagctgggactacagatgcacaccacatccggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagagtaaaggagtttggaattagtccatcagacattcccttctcacagggtagtggcagtcgccctgatctctctccttcttatgaatatgacgacttttctccttcagttaccagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaataagttttagagataatttacttcagtcacctttgttttggaaaggactcaggttttcttgcagctgtaagatatattctatttgtgtttatttcaaagggaagaggaaggatggacaactgttacaattgaccttgcaaaggatatttaaaaaaaaggtagtttttgagattaaccaactttcaaagggcaataaagacatgtgaatttgctcattttaaagcacaacagatgattagcttcaaatttattatttgcattggatgggtactgtctttggaaagtctccttatagacaaatatgctgccttacactatgatggcttcattctgatcaggtattttaaaaattagtaccagaaaagatactggaggtaatataatacagtccttcagctttacagatagtgaaaactgaaggccagaaaaggaactaaaactcagcagttcataggggtagagggaaataacctgagaaagccgagttaaatcttaaaatttttactataaggntagagatgatacaagtgaactctgcaaaatagttttgtgaaattaaacaaaaaaatctactcttaatgtatat

SEQ ID NO: 295 - DNA, 4215 bp, Homo sapiens
  CDS (92)..(3928)
  misc_feature (1)...(4215): n = a,t,c or g
ggcacgaggaaacctctaggtccaccacctccatcttacacgtgtttccgttgtggtaaacctggacattatattaagaattgcccaacaaatggggataaaaactttgaatctggtcctaggattaaaaagagcactggaattcccagaagttttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccagccaccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctgggtcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagattaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaaccgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctcccttctcgggaataaagattctggcatctgggaccaggaaaaataaacccaaggggaagaagagagatttgncctaaaaaagggaccgggggnttcccaaaaaaggtaattcctaggtcccccagggggccggaaacctccttggttccc

SEQ ID NO: 296 - DNA, 1522 bp, Homo sapiens
  CDS (374)..(1318)
gcacgaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagaaaaaaaaaaaaaaaa

SEQ ID NO: 297 - DNA, 4394 bp, Homo sapiens
  CDS (316)..(3210)
cgctccgtaatttccgggtcgacgatttcgtggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaaaaaaaaaa

SEQ ID NO: 298 - DNA, 4798 bp, Homo sapiens
  CDS (326)..(2320)
acactaggaggatcatgtatataactatctattcgatgatgaagataccccaccaaacccaaaaaaagagatctctcgaggatccgaattcgcggccgcgtcgacctgacttagaacaacttttttgacttcctgcagggaggacccttacagtatttttggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaaaaaaaaaaaaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagccttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttcaaaaaaaaaaaaaa

SEQ ID NO: 299 - DNA, 6799 bp, Homo sapiens
  CDS (249)..(2405)
tgcggtaccggtccggaattcccgggtcgacccacgcgtccgcggacgcgtggggctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttaacggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaagacgtcattgtccctgagagtggagaaccagtaggcaccagagagatcaaatgctgcatccgacagatccaggaactcatcatctcccgacttaatcaggcagtggctaataagctgatcagctcagtggattacctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccatcccatgctccagggcatcatgaatcggctctgcaagtccaattctgagcagccaaacagaggactagatgattctacttgaaagcaaagacctttctctttcactctctagttatttccttccccctcaccatttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccgggcatgggggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggtgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgtgaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgagaggcagaggtcatggtgagccgagatcacgccactgcactccagcctgggcaacagagcgagactctatcaaaaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtactttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcagatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctc

SEQ ID NO: 300 - DNA, 3721 bp, Homo sapiens
  CDS (22)..(2517)
ggtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatcttcagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttgtttttgttttttaagggaaacgaaatggaattcgaagggaccttttcactaaccccacttctgtgtgttctgcatggtgcctgccccagggcatctgccaactccagtatcagctctcacagtgtacttggtaccatccctgggctctgctggcgagacgaaacagctgtagagatgaaaacaggctgcagaggctggcacagctggccggcttttctccatctggggacagtcctactccaagaacactgcacaccagctcctcacacagatcccacttacggcgcgcaacgggttctaggctgcaggcagctcgaggacccgcggccccgccccggctcggcctggcagatagcagaggcagcaggccgtgccggggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaagggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcgactgtttttccaatgacattcacaagctagataccagcaccatgacatggactcttatctgtaca

SEQ ID NO: 301 - DNA, 2592 bp, Homo sapiens
  CDS (133)..(2316)
aagctggtacgcctgcaggtaccggtccggaattcccgggtcgacccacgcgtccggacccggcctcctagggggtcgtcgtggtgcagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaattctctcctaatcttgttcgatatgatgatattgaaggggctaattacttccagcaagcaaatgagctctcaaagctagtgaaccagcagcttcttgctgacccacttgttccacctcagctaactctaaaagacttctacatgacagattcgattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaatt

SEQ ID NO: 302 - DNA, 2571 bp, Homo sapiens
  CDS (404)..(1678)
taagcttgcggccgccaattttttttttttttttttttttatggttctgtactttattattaaatacataggtgcaaataagaattttcattttaatctgtcaacgacaatctgttgaaaccctgctgtgtgccttgtgccatgctgctctgttaggggactggggaggccaggacatgctgccagggagctcccggctcagtgggaaagagtaaatgcagagtgctttgctactggtttaaaagaaaggaacacaaatatgattgctttcttactctgggtttgcctttctggcatgttgcctggttcccaagacgaagtctcggatgtgtacatatttgagagttcagtactgcagtatctattcagtgaagtataaacgaaagagcatttttcaaaacaaatggtatgtaatatttttgtcttctttagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacttattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctattaatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcggacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccaaaaaaaaaaaa

SEQ ID NO: 303 - DNA, 2089 bp, Homo sapiens
  CDS (765)..(1190)
  misc_feature (1)...(2089): n = a,t,c or g
atttggccctcgagcagcaattcggcacgagtgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcactttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctgntattaaaaaaaaaaaa

SEQ ID NO: 304 - DNA, 1757 bp, Homo sapiens
  CDS (190)..(1404)
ccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttaaaaaaaaaaaa

SEQ ID NO: 305 - DNA, 2080 bp, Homo sapiens
  CDS (518)..(1633)
agtcccgtccggaattcccgggtcgacccacgcgtccgcaggtggagggtttgggccagatcctgggtcagggaccacattgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatataaaaatatataaatgccacggtcctgctctggtcaataaaggatcctttgttgatacgta

SEQ ID NO: 306 - DNA, 2029 bp, Homo sapiens
  CDS (518)..(1582)
agtcccgtccggaattcccgggtcgacccacgcgtccgcaggtggagggtttgggccagatcctgggtcagggaccacattgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatataaaaatatataaatgccacggtcctgctctggtcaataaaggatcctttgttgatacgta

SEQ ID NO: 307 - DNA, 2982 bp, Homo sapiens
  CDS (198)..(2474)
cggaattcccgggtcgacgatttcgtgcgatggcgcgacctcggctcactgcaagctccgcctcccgggctcagcctctggagtagctgggatcacaggcgcccaccaccacgcccggctaattttttgtatttttagtagggacggggtttcaccatgttggtcaggctggtctcaaactacaggcgtgagccaccatgcccgcccaagaagtggaaatatcttttaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtgccaaacaagagagaaaccaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggaaaaaaaaaaaa

SEQ ID NO: 308 - DNA, 1354 bp, Homo sapiens
  CDS (226)..(1251)
ttctcccaatctctatttcatcgttgctctgttctatttcttacttcctctttatatactcttcatacctccactgtatcgcgaacacacaaaattgtacgcttggagtaccgttccggaattcccgggtcgacccacgcgtccgggtgaggcggccgaaatcgtaggacttccgaaagcagcggtggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattatattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcgagaccagcctgagaaacatagtgagcccttgtctctacaaaaaaaaaaaa

SEQ ID NO: 309 - DNA, 2769 bp, Homo sapiens
  CDS (248)..(2659)
cgctagcgtttaaacttaagcttggtaccgagctcggatccactagtccagtgtggtggaattcatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgccgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaaaaaaaaaaaa

SEQ ID NO: 310 - DNA, 5006 bp, Homo sapiens
  CDS (191)..(4699)
ttttgtccccggtccggactctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagaggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaaaa

SEQ ID NO: 311 - DNA, 1584 bp, Homo sapiens
  CDS (145)..(1476)
atttggccctcgaggccaagaattcggcacgaggcagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaaaaaaaa

SEQ ID NO: 312 - DNA, 1051 bp, Homo sapiens
  CDS (79)..(558)
atttggccctcgaggccaagaattcggcacgaggggcaggcaacagagtggcggccgctacggccctgtaacagggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaaaaaaaaa

SEQ ID NO: 313 - DNA, 1825 bp, Homo sapiens
  CDS (234)..(1235)
accggaacggaattcccggggcgagccacgcgtccggcctgggggtcctggctgaactggtctggtgttaagggggccccctgacccccttgaagagggggctgggctgggtgagggggggtggccaacccccagccaggttcccaggcaggatgagctggggttggggtggctaggccgagggccttgggagctgggcagtctgggctgggctgggctgggcagggcgccacatggaagctggaggagcaacgggagcgctgggcgtggggtgcaaattgcccagtgccttctgtttcccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaagaaataaacgtggtatgttcctgaaaaaaaaaaaaa

SEQ ID NO: 314 - DNA, 3394 bp, Homo sapiens
  CDS (417)..(1934)
ggaaatctgggaggagtgtcctttgggcagcattttaaaagggggagggaactgcggctaaagagacgttcggtgatgggagcgcaatgtatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccaagccgcccgaggtggagccagatctgggggaaaaggtacacacggaggggcgctcagagccgatcctgttgccctctcggctcccagagccggccggggccccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccctgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacagtcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccaaaaaaaaaaaaa

SEQ ID NO: 315 - DNA, 3398 bp, Homo sapiens
  CDS (130)..(2286)
taagcttgcggccgcccgggcccgggcccgcgtcgggcgcctggctctgtacgcgagcccggggatctgcggccttcgtgccccccctcccgggaggagcgtggagcggcggcggcggcggcggcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataaaaaaaaaaaaa

SEQ ID NO: 316 - DNA, 872 bp, Homo sapiens
  CDS (61)..(639)
atttggccctcgaggccaagaattcggcacgaggaccagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcaaaaaaaaaaaaa

SEQ ID NO: 317 - DNA, 1639 bp, Homo sapiens
  CDS (93)..(668)
tttgacacgcctgcggtaccggtccggaattcccgggtcgacccacgcgtccgcccacgcgtccgggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattcattcattcattcattcattcattcttctctccagagagtcaggggcacctccagaatctctactttgagagtaattctcatgtgatgaatccttgttcctccaaaggattttggtctctggttctacacaggtttcctgcttggggcccccagctgcctgggcaggaactcacccattcctccactctctgctggagttgaggaggctggtggagcacagacagttcccccaaagcaatgcctcaaccctgcgagggcctgagcacatcgagagtgagctt

SEQ ID NO: 318 - DNA, 842 bp, Homo sapiens
  CDS (61)..(609)
atttggccctcgaggccaagaattcggcacgaggaccagcaggcatgcctccttggtctcatgttgaccttagagtttgggattctggaattcgatccttcatggataggcagctggacacagaggtcgtggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcaaaaaaaaaaaaa

SEQ ID NO: 319 - DNA, 6757 bp, Homo sapiens
  CDS (182)..(1957)
gcacgagcggccgtggcctcgaggcaggcgggacgtgctttgcctccaccgatctccctgtgggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagttctgttcagaatagtgaacgtggcaaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccggctaagtttttgtattttagtagagacggggtttcaccatgttggccaggatggtctcgatctcctgacctcgtgatccacccaccccggcctcccaaagtgctgggattacaggcatgagccactgcgcccggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggccgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 320 - DNA, 1840 bp, Homo sapiens
  CDS (182)..(1600)
ccggaaccccgggtcgacccacgcgtccggtcagctgaagggaaacaaacaaaaaggaaccagaggccacttgtatatataggtctcttcagcatttattgggggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagacgcagagtattacttccaaaaggaattcagtaaagagcttactcctgtagcgaaacaactgctccatctgcggtatggcaactgtcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagacatatttc

SEQ ID NO: 321 - DNA, 2539 bp, Homo sapiens
  CDS (178)..(963)
cggaactctggaggaacgctgagctgagcagcaccgaggacagcgcccggcagcgcccgcgcccaggtctccctccgcagccctgactcgcgcacacgctgagcttttgctcactccccttcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataaccttaaaaaaaaaaaaa

SEQ ID NO: 322 - DNA, 1311 bp, Homo sapiens
  CDS (241)..(795)
ctgcaggtaccggtccggaattcccgggtcgacccacgcgtccggaagtggcagggcagggtgtgtaccaggaagaagatgctggcgcaccctgggctggctggggaggtgaggccagagggaggatggagcccagagagggaatgtgggtgatgaggttgggccaggcccctaaaccccaagccccagaggcccactccagtgccccccacaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgcctctctctctgtcgcccaggctggagtgcggtggtgcgacctcggctcactgcaacctctgcctcctgggttcaagcgattctcatgcttcagcctcccgagtagctgggattacagaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttaattggctgtggtttcgaaatggctgatcatgaggaagagtctgatccgacacttggaggagcgaggggtgcaggtgaggccgtgaccaccacttccaccgcacacagacctggcagcagggttccggtcccactctgctgccaactagctgcatcactcgggcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcaaaaaaaaaaaaa

SEQ ID NO: 323 - DNA, 6487 bp, Homo sapiens
  CDS (164)..(4093)
ctgcaggaattcggcacgagccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattaaagaagaagcagtattaacatcaactgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaaaaaaaaaa

SEQ ID NO: 324 - DNA, 6445 bp, Homo sapiens
  CDS (164)..(4051)
ctgcaggaattcggcacgagccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattaaagaagaagcagtattaacatcaactgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaaaaaaaaaa

SEQ ID NO: 325 - DNA, 6475 bp, Homo sapiens
  CDS (219)..(5957)
gcacagcccggccggtgtttcaggccctttaagaggcgagctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggatgatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaaaaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacacgcagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaa

SEQ ID NO: 326 - DNA, 2064 bp, Homo sapiens
  CDS (85)..(1620)
gatggctcagggttcttggacattggcgctacgaccttagggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcttactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaacatctttgatgtctggttttcttccggcttcttttttattactgatgtaaaattcacataacataaaattaaccactttaactagccaggcacagtggctcatggctataatcctagtactttgggaggtagaagtgaaaggatcactggaggccaagagttcaaggttaaagtgaactgtgattgtgctgctgcactccagagcctaggtgacagagtaagaccctgtctcttaaaaaaaaaaaaa

SEQ ID NO: 327 - DNA, 6080 bp, Homo sapiens
  CDS (96)..(2543)
gtaccgtccgaattccaggtcgacttcgctgtcgacgatttcgtttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattaacaatgttcaaactgactgcactggtgatggtccctggcaatccaacctggcaccatcgcagttggagtactatgcatcttcaccagatgaaaaggctctagtagaagctgctgcaaggattggtattgtgcttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccggacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataattaaaaaaaaaaaa

SEQ ID NO: 328 - DNA, 4663 bp, Homo sapiens
  CDS (292)..(3600)
attataccgaaaagaagttctagagaaattaatagaaaaatgtgtttctaaaggctacgtcttccagatggagatgattgttcgggcaagacagttgaattatactattggcgagcacccgcggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgaaaaaaaaaaaa

SEQ ID NO: 329 - DNA, 4928 bp, Homo sapiens
  CDS (241)..(3513)
ccactttgtacaagaaagctgggtacgcgtaagcttgggcccctcgagggatactctagagcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccggaaaaaaaaaaaaa

SEQ ID NO: 330 - DNA, 7615 bp, Homo sapiens
  CDS (153)..(3587)
  misc_feature (1)...(7615): n = a,t,c or g
aatcaactcatcactctgtgtacccaacangctccgggccagaaagagtgcgataatgccctgcnnnnnntccgagactgttaaggggatgttggacacatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctttgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgtaatgcctgccgcatcgcctcatccaagacggccaacccagtagccaagaggcacttcgtccagtcggccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaaagcattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtggggccagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaaaaaaaaaaaa

SEQ ID NO: 331 - DNA, 1987 bp, Homo sapiens
  CDS (460)..(1830)
tgcccgtacgagcgcctgagccaagcttggcacgaaggttaaatttttctgcatttaaaaaatgtgcggattggtctggaatccagaggctggtaccaccttcctttctaaaataaaatctctctggcatgaagtcaccgcctatttcacatccggtttgccctgggacgtattactactgtcttggtaaagagaaatcttttgttgtatagctgcagattggatattgggaagcaaatttgggtgtgaaatcttcagcaaaggagcacgcagagtccatgatggctcataccaagtgagtgagaggcagagcgaggacgcccctttgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagttcctctgcactgggaatttatttatgttctcaacgcagtaattcccatctgcctttattgcctctgtcttaaagaatttgaaagtttccttattttcataattcatttaagacaagagacccctgtctg

SEQ ID NO: 332 - DNA, 6378 bp, Homo sapiens
  CDS (271)..(5037)
  misc_feature (1)...(6378): n = a,t,c or g
atttggccctcgaggccaagaattcggcacgaggaggacagagtgcagccttttcctcccctaatagaaaagccattgccctcttttcctcccctaatagaaaagccattgccctcttttcctccacccttaagaagacctgcatctgttggaccaacagacaactatccggcttacggccaggggagcccctgcagctgcacagaaccagtttcttatgtatctggcggtaattgggaaagcttctgagaaagtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcagtgagactgggagactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaaaaaaaaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggcacaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaggaactggatgtctttttaattttgagcagaaggaggtcgacgcggccgcggtcgacgcggccgcgaattcggatcctcgagagatctctttttttgggtttggtggggtatcttcatcatcgaatagatagttatatacatcatgccaatcaaaantttctccgat

SEQ ID NO: 333 - DNA, 8608 bp, Homo sapiens
  CDS (1)..(7785)
atggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatagcatggatttggatatgaaacaagattgtagtcaactggtagaaagaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgtaaaaaaaaaaa

SEQ ID NO: 334 - DNA, 2163 bp, Homo sapiens
  CDS (869)..(1336)
aacttcgaaacccgattacgccaagcttggcacgaggtgtgtggggagcgggcgtcggatttgtccgtgaggattttaaaatggggccatttgagccctggcaaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaagcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccaaaaaaaaaaaaaa

SEQ ID NO: 335 - DNA, 2909 bp, Homo sapiens
  CDS (86)..(2302)
taagcttgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaattcgaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccaaaaaaaaaaaa

SEQ ID NO: 336 - DNA, 2450 bp, Homo sapiens
  CDS (105)..(2258)
gcgcccgctgtaccggtccggaattcccgggtcgacgatttcgtccgcgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 337 - DNA, 2513 bp, Homo sapiens
  CDS (105)..(2309)
gcgcccgctgtaccggtccggaattcccgggtcgacgatttcgtccgcgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgtaaaaaaaaaaaa

SEQ ID NO: 338 - DNA, 4295 bp, Homo sapiens
  CDS (153)..(3389)
atttggccctcgaggccaagaattcggcacgagcggcacgagaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacatgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaa

SEQ ID NO: 339 - DNA, 4091 bp, Homo sapiens
  CDS (77)..(2515)
attggatcgatgactattagccagagcggtcggaattcggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagctacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagtcgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcgacgactgtaagggcaagaggcacctcgacgcgcaccccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaaaaaaaaa

SEQ ID NO: 340 - DNA, 2553 bp, Homo sapiens
  CDS (551)..(1456)
gcaacgcctgcaggaattcggcacgagcaggcatcgcagaccctgacgccactggctgtacaagctgccccccagtattgcaggtcaagtggctggtcagcaggggctggccgtgtggacaattcctacagcaactgtggctgccctcccaggactgaccgctgcttctcctacggggggagtgttcaagccacctttagccggtctccaagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcagcgttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacttgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgaaaaaaaaaaaa

SEQ ID NO: 341 - DNA, 3136 bp, Homo sapiens
  CDS (439)..(2304)
atacgactggaagtaaatagttctcttctggaatattacactgaattagatgcagttgtgctacatggtgtgaaggacaagccagtgctttctctcaagaaccggcccggaattcccgggtcgacccacgcgtccgggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacatggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggttaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactgaaaaaaaaaaaa

SEQ ID NO: 342 - DNA, 3064 bp, Homo sapiens
  CDS (439)..(2232)
atacgactggaagtaaatagttctcttctggaatattacactgaattagatgcagttgtgctacatggtgtgaaggacaagccagtgctttctctcaagaaccggcccggaattcccgggtcgacccacgcgtccgggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacatggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggttaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactgaaaaaaaaaaaa

SEQ ID NO: 343 - DNA, 5273 bp, Homo sapiens
  CDS (328)..(4728)
tcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagactacatctaccatctgcgctgctatgtctatcaagccagaaacctcttggctttagataaggatagcttttcagatccatttgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtaggccagtgcaccatcgagcgcctggatcgctttcgctgtgacccttatgcagggaaagaggacatcgtcccacagctcaaagcctcccttctgtctgccccaccatgccgggacatcgttatcgaaatggaagacaccaaaccattactggcttctaagtgcttaagcagtatgtcaacagcactcagcaaaatggcttctccagcgacagtgcatctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcatatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttccagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccgttacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaa

SEQ ID NO: 344 - DNA, 5216 bp, Homo sapiens
  CDS (328)..(4671)
tcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagactacatctaccatctgcgctgctatgtctatcaagccagaaacctcttggctttagataaggatagcttttcagatccatttgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtaggccagtgcaccatcgagcgcctggatcgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcatatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttccagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccgttacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaa

SEQ ID NO: 345 - DNA, 5364 bp, Homo sapiens
  CDS (328)..(4818)
tcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagactacatctaccatctgcgctgctatgtctatcaagccagaaacctcttggctttagataaggatagcttttcagatccatttgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtaggccagtgcaccatcgagcgcctggatcgctttcgctgtgacccttatgcagggaaagaggacatcgtcccacagctcaaagcctcccttctgtctgccccaccatgccgggacatcgttatcgaaatggaagacaccaaaccattactggcttctaagtgcttaagcagtatgtcaacagcactcagcaaaatggcttctccagcgacagtgcatctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcatatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccgttacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaaa

SEQ ID NO: 346 - DNA, 1414 bp, Homo sapiens
  CDS (175)..(975)
gcagattcagctgcctagcgtttaaacttaagcttggtaccgagctcggatccactagtccagtgtggtggaattcgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactggaaaaaaaaaaa

SEQ ID NO: 347 - DNA, 4351 bp, Homo sapiens
  CDS (13)..(3378)
cttcgacccccgatgattggaatgggcgtgatgtatataactatctattcgatgatgaagataccccaccaaacccaaaaaaagagatctctcgaggatccgaattcgcggccgcgtcgaccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggttggaaatcttccatttctcttgagggttttttttaatgagtgttaaatatgttaaaatttttatttctacctcatgtgtttttttaaattattacttgaagttttttatttaataaattttttctactaatgg

SEQ ID NO: 348 - DNA, 4062 bp, Homo sapiens
  CDS (25)..(2976)
tcactccaacggctgccgggactgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagtaaaaaaaaaaaaaaagggcggccgctctagagtatccctcgaggggcccaagcttacgcgtacccagctttcttgtacaaagtgg

SEQ ID NO: 349 - DNA, 4139 bp, Homo sapiens
  CDS (260)..(2164)
ccatgcggtaccggtccggaattcccgggtcgacccacgcgtccgaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactagctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccgggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggacgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaaaaaaaaaa

SEQ ID NO: 350 - DNA, 2461 bp, Homo sapiens
  CDS (232)..(2358)
atagggaatttggccctcgagcagtagcttcggcacgagggcatgacatttttggcacaatgcaactgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaaaaaaaaaaa

SEQ ID NO: 351 - DNA, 5238 bp, Homo sapiens
  CDS (278)..(1108)
taagcttgcggccgcggcggcggcggccgggaaggagcatcaaagatgaagaagaagagacagtctttcgagaggtggtcagtttttccccggaccccctgccagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggtcacaccagcacagaggaaggagcggggccaggccggtgcccctggcgtgggatgcgcagggctctgcctgcctctggtctatcagtcctgcccgttcccagagccccagggatgttctcagcccttaatttagctttaaatgagtaaattaatccaataactaaagagcctctttactgcccgtgattctgataatcgaatgagaggtgtgccagaggacaatgggaccgcgcagccacagccagttggggcccagcccctgcccccctgcccttgcagcagcgctgaccgcctctcccgcgccctcttctggcgggcttgtggaacgacgggggtgatgcccagcagcctccagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggttattttccccgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagagcttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctgtgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctctatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaaa

SEQ ID NO: 352 - DNA, 4495 bp, Homo sapiens
  CDS (307)..(3006)
tgccgtaccggtcttgaattcccggttcgacccacgcgtccggaaaggcaaatctaatggtacctggctgttcttaagaatgcatagagaggcttagcaggctgggattgattgaagcttatttcctgcttgaaactgacagtgtttatggccccaacttaaaactgcctattacttcaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttaggcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgcccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaaaaaaaaaaaaaaa

SEQ ID NO: 353 - DNA, 7657 bp, Homo sapiens
  CDS (132)..(3629)
aaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctttgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgtaatgcctgccgcatcgcctcatccaagacggccaacccagtagccaagaggcacttcgtccagtcggccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaaagcattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtggggccagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaaaaaaaaaaaa

SEQ ID NO: 354 - DNA, 1958 bp, Homo sapiens
  CDS (60)..(1775)
aattcccgggtcgagggagtccagctctgcagctggaggtgctcatctgcctggggctcatgggtttggaacgggcactcaatgtgttggcgcctatattctataggaacattgtgaacttgctgactgaaaatgcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtgcgagcaaaaaaaaaaaa

SEQ ID NO: 355 - DNA, 1864 bp, Homo sapiens
  CDS (167)..(1696)
cgggtcgacgatttcgtcctcggaggggcagaggctgaaccgcccctacctgccgcgcatccctccggcttccgccgcggcgccagcccgcgcctgattcgcggcgggagcggcaggagggagaacgccgactccgtggcaggaaagtgaataaacttaattgagaatgtctgaaaaccttgacaagtccaatgtaaatgaagcaggaaaatcaaaatccaatgattctgaggaaggccttgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggcgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccaatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatcc

SEQ ID NO: 356 - DNA, 2850 bp, Homo sapiens
  CDS (81)..(2405)
  misc_feature (1)...(2850): n = a,t,c or g
tgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctggcattggataatggagggtgcggttgtatttggatacccctncccccctttttttgggcaagggngggggnagggaggggtttnaaaatnattggnttt

SEQ ID NO: 357 - DNA, 2787 bp, Homo sapiens
  CDS (81)..(2342)
  misc_feature (1)...(2787): n = a,t,c or g
tgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcagcaccagcaacaagtggtgcaggctgtggaacgggccaagcaggtgaccatggcagaactgaacgccatcattgggcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctggcattggataatggagggtgcggttgtatttggatacccctncccccctttttttgggcaagggngggggnagggaggggtttnaaaatnattggnttt

SEQ ID NO: 358 - DNA, 2780 bp, Homo sapiens
  CDS (219)..(2045)
  misc_feature (1)...(2780): n = a,t,c or g
gtagaagtccttgcntgaggacttgtagctcttcgcctgcggtaccggtccggaattcccgggccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcgccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctggtgaccctggtgctgtggaacaaccagctcacgcacacaggcatggccttcctgggcatgacactgagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtgacactttagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcgcagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttcactttgaaaaaaaaaaaa

SEQ ID NO: 359 - DNA, 533 bp, Homo sapiens
  CDS (239)..(523)
atttgaaaccgctcgtatagccgatcccagctggctagcgtttaaacttaagcttggtaccgagctcggatccactagtccagtgtggtggaattctcaagcccgaatttcttaatctgttacctatctcggcataattcttcataaaaacacaggtgctctccctgccgatcctgtccaactgatctctcaaaccccaaccccttctacaaaacaacaactcctttccttcctgggcatggttggatacttttacctttggatacctggttttgccatcctaacaaaaccattatgtaaactcacaaaagaaaacctagctgatgccatagatcctaaatccttttcccactcctctttccgttccttgaagacagcattagagaatgcttccacactagctctccctgactcatcccaaccctttttcattacacacagccgaagtgcagggctgtgtggtcgaaattcttacacaaggactgggaccgctccctgtggcctttttatccaaacaacttgagcttactgtt

SEQ ID NO: 360 - DNA, 1770 bp, Homo sapiens
  CDS (105)..(1409)
gaatatcgacacgccaagcttggcacgaggggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaaaaaaaaaaa

SEQ ID NO: 361 - DNA, 1417 bp, Homo sapiens
  CDS (18)..(1208)
tgatataacatcattcgatgagaagaaccccacaaacccaaaaaagagatctctcgaggatccgaattcgcggccgcgtcgacgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctggtcgacgcggccgcgaattcggatcctcgagagatctctttttttgggtttggtggggtatcttcatcatcgaatagatagccaactcagaggaaaaaggtaagccatgagcatagcgttcgaggagaggcagtgagtgatgtcggagcgagacatcgagcggaggacgaagaggtaggccgatg

SEQ ID NO: 362 - DNA, 1502 bp, Homo sapiens
  CDS (50)..(1072)
gcacgagtgacactgcagctgcagtcaacctcttcccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaatcctctagcagctgcagcagccgcagcagcagtggcagtgagttcccccttcagtcttcgaactgctccagcagcaacactgttccagacttctgcgcttcctccggcactcctgcggccagctcccggacccattcggaccgcccacactcctgtgctgtttgctccttactaaattccaaataggagtaattgtactgcaataatttttcaaaaaacaaaaaacaaaacaaacaaaagagaactatgcagtgtttatttatagtttaaagtatatctgaagagccaggacttttgatagtgaattgaaaaggttataaaaaagtgggggaggtttgggggtgggagggagggagtggtattttctccacattaaagcattcctcttgaacgttgattgttttagaagtgatctccagcattgatttgtagtggtatctagaccttctgaagcctctgtgactgtgcttttgggcacctgtttccctctgcattgtctgtcctgctttatgaaacaactatacattgtctaagggcattaactggttccaatgtatataaaataatttactctgtagattaaaatcgtacaaaaaaaaaaaaaa

SEQ ID NO: 363 - DNA, 4061 bp, Homo sapiens
  CDS (72)..(3062)
aaattgtaaaccagttgaatgctctgagcagcttagatgaagatcaagatgactgcataaagcaagcaaatatgcgttcagctaaatcagccagttcctctgaagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaacaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaaaaaaaaaaaaaa

SEQ ID NO: 364 - DNA, 1394 bp, Homo sapiens
  CDS (487)..(1053)
acttgacggcactgcgctgcacgaattcggcacgagctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttcagattaaactaattgtgagatggtgaagataatttttctgccctgtgagtgacactggccaggggataggttgaggcagatggtgcccagaagaaagagggcagcacccattgcacatggcaggcctgtatgcgtccgctctagaggatccaagcttacgtgcgcgt

SEQ ID NO: 365 - DNA, 7418 bp, Homo sapiens
  CDS (1)..(5103)
atggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttacccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctgtcaactgtgattcgtgaaggtggtcggggtctagctactgtcatatatccttaccttctgccattcatcagcaagctccctcattccatcacaaatccaaagttggatttcttcaaaaatttcctcacgtctctagttgctgggctgtcaacagagagaactaaaaccagctcttcagagtcctcggcagtaatatctgctttttatgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaaaaaaaaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaaaaaaaaaaaaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctgtttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacattaaagttttatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 366 - DNA, 1497 bp, Homo sapiens
  CDS (317)..(751)
aactagtccagtgcggtggaattcggtggatggatgggtgggtagatgaatggatgcatagatgaatgtatcagtggatggatagttggctagatgggtgggttggtggatgaatggcagagcttgcacctgccagtccatctgacatcaaagccagtgtctctaatggtgacaccaccctcctctgcagcaggaggcagagctgtgggatgaatgaggttcgccaggtctcccttacctatcctgggtccccagctccttctcactctcttcccttgcagcctcgaagcggaggatccctgtgtcccagccgggcatggccgacccccaccagcttttcgatgacacaagttcagcccagagccggggctatggggcccagcgggcacctggtggcctaagttatcctgcagcctctcccacgccccatgcagccttcctggctgacccggtgtccaacatggccatggcctatgggagcagcctggccgcgcagggcaaggagctggtggataagaacgtgagtgggcggggctggtgggagtggggggatgcacggggccacagggcttcagacttgagctctgcctccccagatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggccaccgcctccatcccatgtcccgcccagccccgcccccaacccaaggtgctgagagatctccagctgcacaggccaccgccccagggcgtggccgctgttacagaaacaataaaccctgatgggcatggcaaaaaaaaaaaaaa

SEQ ID NO: 367 - DNA, 973 bp, Homo sapiens
  CDS (375)..(599)
  misc_feature (1)...(973): n = a,t,c or g
gtgtgtggggagggtgtatatggagaaggagccccaagaaaggatcagaacggagaccactgccacctgatgtttcctgcaggggctgcactgtgtctctggctgaggtcacactgacacctggtggtcactggtcactcgcagtcttaaatctagtagggccgaaagtactagaaggaggttgtccagagaggtctgccctcaaaatgctcctgaaagatgcttgcttatgcttttctttaaaaattatttctggggaagggcggggagtggtcacaggatcttatattctctttatttttacttaatttgcatgttatttttagaactcccctttttaagggtcacattttgcctcagaaaaccctgtctgaatgtctcctgtttgtcggtcaggactgactctgccttttctttccttttccatgtgccactcctgtcctccctttgccctccctgatttctgcactgtcctctcccacctgtctgtctcctcttggttttgcccgtgtcagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagtcggggccaccgggctccctgcatcctgccccggctcccagcaggcgtcgttgcctctgccctcctgctcgctctatgctctgccaccagcatttcatcctgtggatgacaacgccaggtggatgcagtgttcttccattggttacttagctccccagattatctgtggaaaggagtgggggcttctaaactgtccactgccaatggggtgcagggtgactgttcctgaaggcagcccttcagggcacagctggccaggggtggccttgtgagtngacacaacaggcttttaggtctctttcttgggcaagggcatctcttgcca

SEQ ID NO: 368 - DNA, 839 bp, Homo sapiens
  CDS (61)..(429)
gctacctatccggaagggctatatctgaaagggtttgcctgtcgcgtcatgtaacttgaaatgtggaattttacccttatatcaaaggtaaagatttcccgggaggtgactatgattgccagcaaattcggtatcggccagcaggtccgccattccctgttaggttatctcggagtggtcgtggatatcgacccggtttattcgctctctgaaccgtcgcctgatgagctggcggtgaatgacgagcttcgcgccgctccgtggtatcacgtagtgatggaggacgataacggcctaccggttcatacctacctggctgaagcccagctaagtagcgaattgcaggatgaacatcctgaacagccatccatggatgagctggcgcagaccatccgcaaacaactccaggccccgcgtctgcgtaactaatccctgaacaaatccccggaaggtttttgccttccggggattttttatttggccaggcccaggcgagggatctcaatagccgggcagcgatccatcaccacatttaacccggcatcccgtgccagtactgccgcttgctcattaatcacccccagttgcatccagagagttttcgcgccaatggcaatagcttcctgtgccacgccccacgccgcttctgaattacggaaaacatcgaccatatcgactttttccggaacgtctgccagcgtgccataccccttctggcccagcagcgttttgccggcaacttttggcgaaaccggaatgacgtgatacccctggtcgagtagatatttcatcacgcgatagctgggacgatcgggtttgtcgcttgcccccaccagcgc

SEQ ID NO: 369 - DNA, 3388 bp, Homo sapiens
  CDS (296)..(2413)
ccatgacgatgttgattacaggtcgctgctacttacgccagcttgaaccttaccctaactaaagggaacacaggctggagctcaaggatccttaattaaattaatccccccccccccccggggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgcgatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagcaaaaaaaaaaaaa

SEQ ID NO: 370 - DNA, 1136 bp, Homo sapiens
  CDS (353)..(727)
ggaattcaatgctgcacaagctctgagccctcctggggctgcgaagttcctctgatgggaggtgtgtggtggccatcccatccctgtgtaagacctggggaaaccactcttcaaggttcaggaggagggagggcggcccccgacccttaaccagagcgaggttgttgctttgtgtccacagggaccaggagcgaaccatgatgccaggtaggaggggctgactgggccctgcgagcgcgtgcctttcctgctgggcagaggccctccacatggggccacgcgggccgggcacaggagggcagtcagatgggcagggcctgagagcctccctcctctccctaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagcccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgcaaaaaaaaaaaaaaa

SEQ ID NO: 371 - DNA, 2575 bp, Homo sapiens
  CDS (225)..(1568)
  misc_feature (1)...(2575): n = a,t,c or g
taagcttgcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcggattgcatcggtgtgtggcggcggggcatgcccagagcaccgggcacggccttcaatgggcgaggacacggacacgcggaaaattaaccacagcttcctgcgggaccacagctatgtgactgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtccgggttaatttttcactccagtgcgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccccctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgcctcgtgccaagctggcgtaatgtggttacgatgtcttcattnntcaggcnncgggccgcttacatcct

SEQ ID NO: 372 - DNA, 7393 bp, Homo sapiens
  CDS (118)..(3012)
taagcttgcttgttcttttggccgaagcggcctacggctgcgagaagacgacagaagggggacgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggaaatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccaagacctccgggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagtaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccgtctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtctttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttctt

SEQ ID NO: 373 - DNA, 1435 bp, Homo sapiens
  CDS (215)..(1084)
ccactttgtacaagaaagctgggtacgcgtaagcttgggcccctcgagggatactctagagcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagacccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaaaaaaaaaaaa

SEQ ID NO: 374 - DNA, 2148 bp, Homo sapiens
  CDS (610)..(1734)
gtaccgctccggaattcccgggtcgacgatttcgtcccacgtgatcctggcctgcagttgggtggctgcggtgagatacctgggttcctgaagggcgggtggttaggtcgtaactactgcccccgccggctgagtctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaatactagaccgtatacatagtcttcaaattaatagcagtttgagcacctactctctcgtagactctgttggaaatacaaagacatttgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaaaaaaaaaaaa

SEQ ID NO: 375 - DNA, 2064 bp, Homo sapiens
  CDS (610)..(1650)
gtaccgctccggaattcccgggtcgacgatttcgtcccacgtgatcctggcctgcagttgggtggctgcggtgagatacctgggttcctgaagggcgggtggttaggtcgtaactactgcccccgccggctgagtctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaaaaaaaaaaaa

SEQ ID NO: 376 - DNA, 2103 bp, Homo sapiens
  CDS (610)..(1689)
gtaccgctccggaattcccgggtcgacgatttcgtcccacgtgatcctggcctgcagttgggtggctgcggtgagatacctgggttcctgaagggcgggtggttaggtcgtaactactgcccccgccggctgagtctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtaagacgtgttagatacgtcaaaaccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaaaaaaaaaaaa

SEQ ID NO: 377 - DNA, 2554 bp, Homo sapiens
  CDS (213)..(1703)
tgcccgcctgctgaattcggcacgaggacacgctgaacagaattcacctcacgtccagtatgagatgggagtatgaacaaacagtcatgcagagtgatgagtgcaaacatggactataaagcggccatagagaatgaactgcacgagtcgctccaactcctgcagagctgagccggagggaatccggaaggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttacagttggaggctccaagtatggtatcatcaacctgcaaagtctgaagacccctacgctcaaggtgttcatgcacgaaaacctctacttcaccaaccggaaggtgagattcggtgtgctgggcctcgctgaatcacttggattcccacattctgctatgcctcatgggactcgcaggactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaaaaaaaaaaaa

SEQ ID NO: 378 - DNA, 3064 bp, Homo sapiens
  CDS (24)..(1031)
aattcggcacgagccgacgccacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggccctggactcggtttcccagcgcggtcaacgcatctggaggggactggaggaaacccccttgttggaagagattccaagagaagcacggttttctctttcccttgccctgactgttggagtaaaaaacctcttaaatccattgtatcagaggtccttacctctctgacagttacaatgatctttgtatctgaactttgcacgtctgccgaaaaatccgaacctgttgactgggatttttaagaatccgtttctcccttttgtgtattccatattggccggccccaaggatgctcgcagaagccagcccccaaccccagcccttccgtatctttcccctccatcgcggctttgcgatgaaagattagcccgcgaacagaggcattgattacaaacatgtccttggcagtggactctgggcctggcattcttcaggtttctgtcaatccagaaacgcgactttcctggacccctgcggctcttcctcccccgcccacatccagccctccaaggccagtccagaggtgaagtttgaggccctccccccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaagggccattcctgcccggagcaccctcctttcccttgcgcttgctctccggtacctgttcctcacctgagctcaagggcagggagaggccgggcctctggcagtccacgaaggaagccgtctgccttcggttatgattttaggaacaagtccaacgagggtgttcaagcagttaatggttgtgctaactcttgtttctactgaagcgggttttgcaaagctgacatcccttaaagataacttgggctttcggaagcggcaaggaaatggcacctgtagttgccaggacaggtggtgtcctcggccaggactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctagtgagtctgagaactggaaaagaccaaggaggggttgatgatttacaaggtccatagaaaaactttttgtgtggtcggaagttggccaagcagaggcccacagcctgatgctactgccccccacccccccaaagatctgaattccctaaagatcaagagggttcagctggccttgggagatgtttgctggagaatgacttcagttttctcctaaggcaatcagattgcaaccattagcattgtatcttatctgcaaatcagtttactccgaggttccccaaggatagttttattaggaccacaggactttactaaccactgaggtaacacgctgcttgtgcagcaattattttgaggtggaggtatttatgggacaagtttataattccatttattaaagggactaacctaaaaaaaaaaaaa

SEQ ID NO: 379 - DNA, 4695 bp, Homo sapiens
  CDS (52)..(1623)
gcacaactcgcgccaaacggggcctaagagaagccggacttcgcaagcaccatgcagtggataaggggcggatcgggaatgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagacaaaaaaaaaaaa

SEQ ID NO: 380 - DNA, 4235 bp, Homo sapiens
  CDS (214)..(3357)
acggtggaattctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctactggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctacc

SEQ ID NO: 381 - DNA, 1947 bp, Homo sapiens
  CDS (121)..(879)
accggtccggaattcccgggtcgacgattcgtggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctcagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggaaaaaaaaaaaa

SEQ ID NO: 382 - DNA, 1763 bp, Homo sapiens
  CDS (146)..(1054)
cttgatcccctgcggtaccggtccggaattcccgggtcgacccacgcgtccgcacccgcttccgtcagcctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcgggtgagccctccagagaggctgggccctgggcttccctaaactgcaccctggatccctcagcatcaactccctagagggaagggagcagtctggtgcagagggtttggtggcagctttgtgtggtgggcttcctggggtctccacccagtgcagtcaggatctatcaaagccttttctcagtggacgatgctgaccacagcaacttccatgatatgccaggggcttgtgtctgcctactggttagactttgaccagtgaccagggacagcctgggccttgggcacactgcccagtgtggtgcttggtacatggaggcctgcagaggtggcactgagcagcagaaagaacatcagctttcaagtttgttaggcctgggtttgagtcttatctaccatttgccaggtaggtgaccattgcccaagaaataacctctctgagtctgttacattttctgtaaaatggagaaggaaggctgggcatggtgactcacacctgtaatcccagcactttgggaggtcaaggtgggtagatcgcttgagctcagcagttcaagaccagtctgggcaacagggtgaaaccctgtctctacgagaaatacaagagttagccaggcgtgatggtggatgcccgtagtaccagctactcatgaggccgaggtacaaggatcgctcgagcccgggaggtcaagccttgaggccaaggtggaagttgcaatgagctgagattgagccactgcactccagcctgagtgacagagcaagaccctatctcaaaaaaaaaaaa

SEQ ID NO: 383 - DNA, 4352 bp, Homo sapiens
  CDS (1)..(3675)
atggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgcggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccacccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgaaaaaaaaaaaa

SEQ ID NO: 384 - DNA, 2008 bp, Homo sapiens
  CDS (217)..(1986)
gctgttcgcctgcggtaccggtccggaattcccgggtcgacgatttcgtacgaaatcgtagggaaaaacaaactcgaagttaatcattcccagctcaaagccttgtgcaagtgctctctgccttcacgcttgcttcctttgggagagaaccttcctcttcttgatcggggattcaggaaggagcccaggagcagaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactggaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtaaaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtgggccggctggcgggcagcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaaaaaaaa

SEQ ID NO: 385 - DNA, 1325 bp, Homo sapiens
  CDS (117)..(1325)
tcgacgatttcgtaagggagagagagagggggactctgtgtgagggaaagaaaacaatgtctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtga

SEQ ID NO: 386 - DNA, 1428 bp, Homo sapiens
  CDS (131)..(1132)
atgaggcctgacgcactgtcgaccggaccggaattcccgggacgagccacgcgtgcgcttgcaactccacctcagcaggggtctctcagtcctctcaaagcaaggaaagagtactgtgtgctgagagaccatggcaaagaatggtccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtacacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcaggaacatttgcaaagcagttgcatcacaactttgcatttattatcttagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaacagcctgattgctgctgaacacactgggtaagtgtttgctgagaatattcacagcaactgaaatggagcagacccgtcaaacatagatgactatgctgaggctcagaaaacaatgccccaaaatgaaa

SEQ ID NO: 387 - DNA, 1380 bp, Homo sapiens
  CDS (131)..(1084)
atgaggcctgacgcactgtcgaccggaccggaattcccgggacgagccacgcgtgcgcttgcaactccacctcagcaggggtctctcagtcctctcaaagcaaggaaagagtactgtgtgctgagagaccatggcaaagaatggtccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtacacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaacagcctgattgctgctgaacacactgggtaagtgtttgctgagaatattcacagcaactgaaatggagcagacccgtcaaacatagatgactatgctgaggctcagaaaacaatgccccaaaatgaaa

SEQ ID NO: 388 - DNA, 1239 bp, Homo sapiens
  CDS (332)..(937)
ggcacgagctgggttggggctgaggaaggcctatgcgcggagggtgcggccttcggctgaggcagaggaccagggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctagcgcagccgagtcggaaccaaccggttgtttggtgaaacctaccccagagcctcccgcggcccacagagcacagactgtttttgccaaccatggcatctggagatgacagtcctatctttgaagatgatgagagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaaaaaaa

SEQ ID NO: 389 - DNA, 1682 bp, Homo sapiens
  CDS (25)..(1197)
gcacgagcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagtatttctttacatgacccagtccatttctcccccttggaaaaacgtttggacgttgggaagaatgatgccacagggctggtgtgtggggaagctagaatcctggccccgcctctgccagccctgcaccataggcaggtgtgccatctcagcgggaaggggaggactggctgctgcagcctgtcctgctctgtgagtgctgagaacatgctggtgtggcctcaatttcagccagtgccaggggagcccctccaccacccccagcctgccccccagggctcctttgtcacaaatctgaaaggttttagaacccaaaaaaaaaaaaa

SEQ ID NO: 390 - DNA, 4103 bp, Homo sapiens
  CDS (104)..(3493)
gttccggaattcccgggtcgacgatttcgtccgaagcgcgggaagcagctcttgtggatcctcagtggcggtggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtaaaaaaaaaaaa

SEQ ID NO: 391 - DNA, 857 bp, Homo sapiens
  CDS (44)..(655)
atttggccctcgaggccaagaattcggcacgagcggcacgaggatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagtactacaagaagttctccattcctgatctagatagacaccagctacctctggatgacgccttgctgagctttgcccacgccaactgcaccctgatcatctcttaccagaagccaaaggaggttgtggtggccgagtctgagctacagaaggaactaaagaaggtgaagacagcccacagcaacgatggggactgcaagacccagtagttggcccctgagccttatacctccaccacagggggtgccgtgagacttcaaggcttggcccttcttgaccacggcagcctcctgtcttctaggagctatcaagggtctctaagaactgggcatggggcactcctagccagtgagtcatggtcatatttcctgagtaaagtcattctgagttacttactgcaaaaaaaaaaaa

SEQ ID NO: 392 - DNA, 3256 bp, Homo sapiens
  CDS (74)..(1777)
ggaattcccgggtcgacgatttcgtcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaaaaaaaaaa

SEQ ID NO: 393 - DNA, 5714 bp, Homo sapiens
  CDS (272)..(4312)
ctgcacgaccggtccggaattcccgggtcgacgatttcgtgatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagccagccgggggaccacagtgctggacaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattactgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctacctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctcatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaaaaaaaaaa

SEQ ID NO: 394 - DNA, 612 bp, Homo sapiens
  CDS (78)..(521)
cctggagctcgttgcctgcaggtaccggtccggaattcccgggtcgacccacgcgtccggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaaaaaaaaa

SEQ ID NO: 395 - DNA, 1691 bp, Homo sapiens
  CDS (153)..(1691)
taattcggcagagggcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacaggtcaggcccctcttctgcagaaatgctgcagtttgctggaggtccactccagaccctctttgcctgtgtttcgccagtggaggatgcaggacaggaaagattgttgcctgctccttcctcaagaagcttcatccaagagggtcactggcctgatgccagccagaggtctcctctgcaaaaacaaacaagcaaacaaaaaacaataaaatacttaggaatatacctaacaaaggagttgaaagacctctgcaaggaaaactacaaaacactgctgaaagaaatagatgatgcaaacaaatggaaacacatcccatgctcatggatgggtagaatcaatgtgaaaatgaccatgctgccaaaagcaatctacaaattcaatgcaatccccatcaaaataccaccatcattcttcacagagttagaaaagacaattctaaaattcatatggaaccaaaaaagagcccacattgtcaaagcaagactaagcaaaaagaacaaatctggaggcatcacactacctgatttcaaacgatactacaaggccacagtcaccaaaacagcatggtactggtatagaaataggcgcatagaccaatggaacagaatagagaacccagaaataaacccaaatacttacagccaactgatctttgacaaagcaaacaaaaacataaaccagggaagggacacccttttcaacagatggtgctgggataattggctagccacatgtaggagaatgaaactggattctcatctctcaccttatataaaaatcaactcgatggattaa

SEQ ID NO: 396 - DNA, 1943 bp, Homo sapiens
  CDS (35)..(1657)
atttggccctcgaggccaagaattcggcacgaggatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaa

SEQ ID NO: 397 - DNA, 1895 bp, Homo sapiens
  CDS (71)..(808)
ttggactgagtgcaatcggaccgcccgaccgggtcggaattaccgggccgacccacgcgtccgccggaagatggaaaggactgagatgatgcccacaattaactcccagctggaatttaaaagtaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttccgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaa

SEQ ID NO: 398 - DNA, 1878 bp, Homo sapiens
  CDS (550)..(1185)
ccgtgccagcttggcacgaggggctcgtgggggggttggctggggagcccacgctgcctggcgactcgggccaccgaatgtgagaccgagtccctttatgtcactagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacatcctttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaagaaaaaaaaaaaa

SEQ ID NO: 399 - DNA, 1573 bp, Homo sapiens
  CDS (163)..(1092)
accggaccggaattcccgggtcgacgatttcatggccagccagggttagatgttctgaggaggcgggagcaaccgagagagcacgtgagcatctgtcctttctacccgttcatctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgggacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctatactgttttctttctgatactggacaatgtattgcggccgctctagaggatccat

SEQ ID NO: 400 - DNA, 3889 bp, Homo sapiens
  CDS (8)..(2908)
ttcacagatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcaggagggtactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggccccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttggaaaaaaaaaaaa

SEQ ID NO: 401 - DNA, 2697 bp, Homo sapiens
  CDS (135)..(1136)
gaggtgcgcccctgccgtaccggtccggaattcccgggtcgacgatttcgtgcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcgcctgggtcgagcacagccttctggtccagcgctgcatgcggcctcaggaccacgtcttccggttgggggctcccagtaaagcgatcctcagcttcttcagcagccagtggccagtgagagcactgacacggctcccgggacctcggcaggatggaagagaagctgaagaaaaccaagatcatctttgtggtgggtgggcctggctcaaggaagggcacccagtgtgagaagatcgtgcagaagtatggctacacccacctctccat

SEQ ID NO: 402 - DNA, 1843 bp, Homo sapiens
  CDS (156)..(1742)
tggcgcgtcgcccccccatcgaaggacgatgatatatctatctattcgatgatgaagataccccaccaaacccaaaaaaagagatctctcgaggatccgaattcgcggccgcgtcgacctcccctacagaagcccccagagcgcagcacctcaccatggactgcacctggaggatcctcttcttggtggcagcagctacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggagcttttgatcctgaagatggtgaaacaatctacgcacagaagttccagggcagagtcaccatgaccgaggacacatctacagacacagcctacatggagctgagcagcctgagatctgaggacacggccgtgtattactgtgcaacccccgttggaaggtgtagtagtaccagctgctatcacccccttggatactggggccagggaaccctggtcaccgtctcctcagcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaatgatcccggaccagatccgtccacacccgccactcagcagctctggccgagctcacagtacaaccacaataaactcttgttgaatgaactctaaaaaaaaaaaa

SEQ ID NO: 403 - DNA, 3727 bp, Homo sapiens
  CDS (152)..(2548)
ttataactctctattcgatgatgaagataccccaccaaacccaaaaaaagagatctctcgaggatccgaattcgcggccgcgtttacgcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaaaaaaaaa

SEQ ID NO: 404 - DNA, 1801 bp, Homo sapiens
  CDS (217)..(1440)
  misc_feature (1)...(1801): n = a,t,c or g
taagcttgcggccgctttttttttttttttttttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatcaaaaaaaaaaaaagggggggccctttaaaaaaaacaaattttaatacccgggggtgggaaagtaaaaattttttttagggggccccaaatttaatttccggggccgggttttaaaaaggggggggggggaaaaacccgggggttccccaattaaacccctttggcaccaaannnannnnnnnnngnnnaantctttttaanctctatactcccagtacaatngcatatttatactaaacctatccctgtccaccttttttagtaccgaacttagacatacattgggtaagcgcctcgccgttatttgatattactaataatttgttccggcccttgttttgtcccacaccctggtct

SEQ ID NO: 405 - DNA, 1786 bp, Homo sapiens
  CDS (263)..(1651)
cgaaaaaattgaagccttacgcccgcggtaccggtccggaattcccgggtcgacccacgcgtccgcctccccttacctcccttctcttctgaattctccattctgggctctttcctgtgaaatctttctttgctttccccatcttttcctcgcattttttcaccatctttccctcaatctccaggagccaatgcgagactttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggagctgggcggggcggggcatcagaactcaggtgttttttatttacgcgtcagggcttttcttgtttaataaagttatgatagctagcaaaaaaaaaaaa

SEQ ID NO: 406 - DNA, 1113 bp, Homo sapiens
  CDS (11)..(913)
ggaattcgccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctacagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgagtaggtttttttcccccgcttctccagtcatctctccctctgcggaagggtgtcgtgtaaaacacacaacaatgagatcgatgtcacagtgagttcagcagcacgtcctgtctgcagatcacacagtgtgttcagaaaagagtattaaatggatccaggctgggaaaagcaaaataaaaacccctgggctgtaaaaaaaaaaaa

SEQ ID NO: 407 - DNA, 1488 bp, Homo sapiens
  CDS (146)..(931)
gagtcgcctgcaggtaccgccccggaattcccgggtcgacccacgcgtccgaggaagcctctgcctcagagatgctgccgctgctgctgccgctgcccctgctgtgggcagggccctcgctcaggatgcaagattccggctggagatgccagagtccgtgacggtgcaggagggtctgtgcatctttgtgcactgttcggtcttctacctcgagtatggctggaaagattctacccctgcttatggccactggttccgggaaggggtcagtgtagaccaggagactccagtggccacaaacaactcaactcaaaaagtgcagaaggagacccagggccgattccacctcctcggtgatccctcaaggaacaactgctccctgagcatcagagacgccaggaggagggacaacggttcatacttcttttgggtggcgagaggaagaacaaaatttagttacaaatattccccgctctctgtgtatgtgacagccctgacccacaggcccgacatcctcatcccggagttcctaaagtctggccatcccagcaacctgacctgctctgtgccctgggtctgtgagcagggaacaccccccatcttctcctggatgtcagctgcccccacctccctgggccccaggaccctccactcctcagtgctcacgatcatcccacggcctcaggaccacggcaccaacctcatctgtcaggtgacgttccccggagctggtgtgaccacggagagaaccatccagctcagtgtctcctggaaatcaggaaccgtggaggaggtggttgttttggccgtgggggtagtggctgtgaagatcctgcttctctgcctttgcctcatcatcctcagtttccacaagaagaaggcggtgagggcagtggaggttgaggagaatgtatatgctgtcatgggttaatctctcaggcctccagactgtacttccagatgtctcctcatccagttcctccacagtctgaatggccatgtttcttcttcattgctggagaatgaagtgcaaatgccactgcctggactgaaggcctttcacgatctgtcttctgctggactctgctcctgatcccccttctccttgcatcacccgaagtctccctacacccaccaggccaagccctctgtgattctgagactttgcatgtgtagttacttctcctgaaatggccttcctccccattcctgccaatccaggtccttatcatccttcaggttgtcttaaatgtcatccaggtgtgtgtatttttatgtaatccttgtatgatattaagcggagatgtggcatttgttcattaatttgtagacatattcagtaaccatactgaatacatataatgactatgtgccagcatttccgtatgtgcaagaagttcatcaatagatatagactcaaagagctctgtcatcaagctgttgttctgaagagcagaaggatacaaataaaaagaaataagtaaaata

SEQ ID NO: 408 - DNA, 1457 bp, Homo sapiens
  CDS (253)..(1140)
cgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaaggaaaaaaaaaaaa

SEQ ID NO: 409 - DNA, 2188 bp, Homo sapiens
  CDS (400)..(1899)
  misc_feature (1)...(2188): n = a,t,c or g
ctaatacggtcacatagggaatttggccctcgacggnatattcggcacgaggcgaatccctgcttaaaggccttgctttcttgtctaacgccgcaaccagtcctctgagttgccaacgtctttcttcttgtctcgacgccccgtgtcacggccacagcgattctctgcttagcaggatcggtccacagcgggacgtgagtctcttcctcctcgcggcttaccgctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaaaaaaaaaaa

SEQ ID NO: 410 - DNA, 2275 bp, Homo sapiens
  CDS (400)..(1986)
  misc_feature (1)...(2275): n = a,t,c or g
ctaatacggtcacatagggaatttggccctcgacggnatattcggcacgaggcgaatccctgcttaaaggccttgctttcttgtctaacgccgcaaccagtcctctgagttgccaacgtctttcttcttgtctcgacgccccgtgtcacggccacagcgattctctgcttagcaggatcggtccacagcgggacgtgagtctcttcctcctcgcggcttaccgctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcaggtatgggccagacccaggtggggctgggagaccgagggacacaaggtggggggagcccagatcgcagcctccctgtcctccccacagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaaaaaaaaaaa

SEQ ID NO: 411 - DNA, 2338 bp, Homo sapiens
  CDS (115)..(1455)
tagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttcggatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctacggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaacccagttttttgtttgtttgtttgagacggagtcttggtctgtcgcccaggctggagtgcagtagcacgatcttggctcactgcaacctccgcctcctgggttaaagtgattctctcagctcagtctcccaggtagctgggattacaggcatgtgccaccacaccccgttaatttttgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaggaagaggaaaaaaaaaaaa

SEQ ID NO: 412 - DNA, 2527 bp, Homo sapiens
  CDS (132)..(1166)
atttggccctcgaggcatagaattcggcacgaggccggccgcgcgctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggaaaaaaaaaaaa

SEQ ID NO: 413 - DNA, 2488 bp, Homo sapiens
  CDS (617)..(1933)
tttgaatgcagatgctgttgcgcctgccggaccggaccggaattcccgggtcgacgatttcgtccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcgggtcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccagggtggagtgcaggggcccaatctcgggtcactgcaagctctgcctcccaagttcatgccattctcctgcctaaccctcccaagaagttggggactacaggcacctgccaccatgcccagttaattttttttttttaagaaaaaagggggtctccccttttggcccagaagggttttaatttaaccttggaaccccccaacctcgccctcccaaagggtg

SEQ ID NO: 414 - DNA, 1240 bp, Homo sapiens
  CDS (82)..(1080)
atttggccctcgaggccaagaattcggcacgagactggcccgactactttcgttccgtcttccatcgtgggctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaaaaaaaaaaaa

SEQ ID NO: 415 - DNA, 6082 bp, Homo sapiens
  CDS (262)..(3144)
accgctccggaattcccgggtcgacgatttcgtcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggcttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctaattcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggccgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgctttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatattaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcagcctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgtgcttgatcaaaggtcatttgtgtagatgagtaattaaaaaatatttaaatcacaaaaaaaaaaaa

SEQ ID NO: 416 - DNA, 1782 bp, Homo sapiens
  CDS (101)..(1579)
ctgcggtaccggtccggaattcccgggtcgacccacgcgtccgccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaaaaaaaaaaaa

SEQ ID NO: 417 - DNA, 3297 bp, Homo sapiens
  CDS (44)..(2890)
gtcgacgatttcgtggcctggccggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggacaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccggcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcggcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccaagcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgtaaaaaaaaaaaa

SEQ ID NO: 418 - DNA, 4562 bp, Homo sapiens
  CDS (139)..(3189)
gctctggagttcccgggtcgacgatttcgtagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcacagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaaa

SEQ ID NO: 419 - DNA, 1237 bp, Homo sapiens
  CDS (75)..(992)
ccactttgtacaagaaagctgggtacgcgtaagcttgggcccctcgagggatactctagagcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccagtcctctgccagcgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaaaaaaaaaaaa

SEQ ID NO: 420 - DNA, 1432 bp, Homo sapiens
  CDS (59)..(1030)
gcacgaggacccagcctaaccatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggccgacccggactgcagcaacgggcagcctcaggcggcccccaccccaggagccccgcagaacaggaaggaggccaaccctacacccctgacgcctggcgcgtcctccctgagccaactgggtgcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgccaaaaaaaaaaaa

SEQ ID NO: 421 - DNA, 2145 bp, Homo sapiens
  CDS (105)..(1661)
  misc_feature (1)...(2145): n = a,t,c or g
gcattgaagccgtacgcctgcaggtaccggtccggaattcccgggtcgacccacgcgtccggcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcgcctctgccgggaagttcctgtgttgtgctgatgatttgtgccaggatacatattcagtacctgtggggaaataactgtcaccacccacaaattagacatttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagancaaaactgtgctg

SEQ ID NO: 422 - DNA, 1966 bp, Homo sapiens
  CDS (115)..(1758)
cttggccatcgatatccgtagacccagctggctagcgtttaaacttaagcttggtaccgagctcggatccactagtccagtgtggtggaattcgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaa

SEQ ID NO: 423 - DNA, 2341 bp, Homo sapiens
  CDS (704)..(1891)
acccctgcggtaccggtccggaattcccgggtcgacgatttcgtagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggttccttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaattggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaaaaaaaaaaa

SEQ ID NO: 424 - DNA, 1593 bp, Homo sapiens
  CDS (301)..(1167)
atttggccctcgaggccaagaattcggcacgagggaggcttcaccctcatgacctcatccaaccctaattacctcgtaaagaccccacctccacacaccatcacattgaagattagggcttcaacatgtatgtttggtgtgggggcggggggcaagatacagacatttagtccatagcactgtatgtcttaaaattattgtttaaggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttactagcttcacataaatgaaaaaaaaaaaaaa

SEQ ID NO: 425 - DNA, 1491 bp, Homo sapiens
  CDS (301)..(1065)
atttggccctcgaggccaagaattcggcacgagggaggcttcaccctcatgacctcatccaaccctaattacctcgtaaagaccccacctccacacaccatcacattgaagattagggcttcaacatgtatgtttggtgtgggggcggggggcaagatacagacatttagtccatagcactgtatgtcttaaaattattgtttaaggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgagaaaaaacttattctgagaaagccaccgataaccatgttaatcatagctcttgccctgaaccggtgccaaatggagtgaagaaagtatctgtgagaacagcctgggagaagaataaatcagttagctacgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttactagcttcacataaatgaaaaaaaaaaaaaa

SEQ ID NO: 426 - DNA, 833 bp, Homo sapiens
  CDS (95)..(745)
agacgcactggtccggaattcccgggtcgacgatttcgtggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgaaaaaaaaaaaa

SEQ ID NO: 427 - DNA, 1882 bp, Homo sapiens
  CDS (100)..(1371)
ttggaattctagggagacctaagctggctagcgtttaaacttaagcttggtaccgagctcggatccactagtccagtgtggtggaattcgggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtgatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgagaaaaaaaaaaaaa

SEQ ID NO: 428 - DNA, 2840 bp, Homo sapiens
  CDS (81)..(2459)
gcacgaggtgtcgctggccttagcagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacaagagcagagatattaaattataaccaactttcaatttcctgtgctaattaagggaaattctgttgtggataatcaaacatagccaataaatttttttaaaactccaaaaaaaaaaaaa

SEQ ID NO: 429 - DNA, 3851 bp, Homo sapiens
  CDS (222)..(2519)
gagagcggcgcctcactactgactatgctgcgaaaacactacataaggggggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatatgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgttaaaaaaaaaaaa

SEQ ID NO: 430 - DNA, 939 bp, Homo sapiens
  CDS (92)..(646)
ctagatagcgatcaagctggctagcgtttaaacttaagcttggtaccgagctcggatccactagtccagtgtggtggaattcgcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaaaaaaaaaaaaaa

SEQ ID NO: 431 - DNA, 1212 bp, Homo sapiens
  CDS (135)..(1007)
gcctgccgtaccggtccggaattcccgggtcgacccacgcgtccgctccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaccctgctttacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgaaaaaaaaaaaa

SEQ ID NO: 432 - DNA, 1399 bp, Homo sapiens
  CDS (313)..(1347)
tcggcactaccagcctgcttagttaaccctcactaaagggaataagcttgcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaa

SEQ ID NO: 433 - DNA, 759 bp, Homo sapiens
  CDS (137)..(628)
atacaagctacttgttctttttgcaggatcccatcgattcgaattccgttgctgtcgggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctacagacttgtgattaaacatttaaaaatttttaaaaaaaaaaaaaaa

SEQ ID NO: 434 - DNA, 2627 bp, Homo sapiens
  CDS (110)..(1363)
gcttcgcccgagcgcgggcggttccttgcgcttcagtcccccccgggtcccctcctgctcccgggttttctgccccgttcccccgggtggctgtgggctcccgagccccatgtcggccagccggccccagggccccacgaccccatggtgtctcccaagaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgccttcggcaagtgcaggtgagtctgccctgctggccccgacgatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcagtccgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccaga

SEQ ID NO: 435 - DNA, 1864 bp, Homo sapiens
  CDS (164)..(1420)
taagcttgcggccgcgcgacatttctttttttttttttttttgccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaa

SEQ ID NO: 436 - DNA, 3289 bp, Homo sapiens
  CDS (201)..(2558)
attgataggctgatgtatataactatctattcgatgatgaagataccccaccaaacccaaaaaaagagatctctcgaggatccgaattcgcggccgcgtcgacgtccgggttcgcttgcctcgtcagcgtccgcgtttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcagaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactcggcgcaagctta

SEQ ID NO: 437 - DNA, 1650 bp, Homo sapiens
  CDS (45)..(857)
atttggccctcgaggaaggaattcggcacgaggggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtgggggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagcaaaaaaaaaaaaa

SEQ ID NO: 438 - DNA, 603 bp, Homo sapiens
  CDS (251)..(469)
ttcggctcgacccacgcgtccgcagctactcggaaggctgaggcattagaattattgaacccgggaggtggaggttgtagtgagctgagattgtgccactgcactctagcctggttgacagagtgagactccctctcaaaaaataaaaataaaatataaataaataaaacaattggggcctcactattttatatttttgtctcaaaaaacaactctctcttgtggtgtgtgcttgattctgcttcttgtcatgtcttctcacaagtcttttaagagtaagcgattcctggccaagaaacaaaagccaaatcgtcccattctccagtggatctggttgaaaactggtaataaaatcaggcacaactggaaaggagacattgcagaacagccaagctgggtctataaggaactgcacgtgagctggcacacatattcacgctgtatcaaggtcacggccatcttactatagcaagctgaaaacgtcaccactgtctgaacagttggacgtgttttattgggaatatattttttctctttgcttatatgccctgcgatagtaggctgggttcagtaataaatatgtgagaccttttgtttcaggaa

SEQ ID NO: 439 - DNA, 1816 bp, Homo sapiens
  CDS (178)..(729)
ttgcgttccggaattcccgggtcgacccacgcgtccggttgggaagggcgctcctgggcggcttgcggggtgaacctgcagggagcctggggagagcggtcaggggtcagagcgtccgaggcggaatccccggggaaacgcgcagatgtaagctggtggagccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcgttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggacgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacactgtgtccttatggcttcactgcaggtaatgcctttcccttcaggaagccccagaacacccacaggtcttggtaacaaacgccaccttacactctgcaggctgcagcggcagctccagatggcctcctgagctggacgaccccaggtctccagacatctagggaccagagcaggtttgggaacacagagggaagacaggatgggagtgtagccacagaacccacctgcaccctgacaggcacaccccactgaagagcctgagtcccaggaggcctcctggaagcccaggactgcccacccaccacgctggtgcccaccgcctggccagccaagccctgccgatcagacatgtgggctccccgaagcccagccagagactgccgtgctgtgggtgccaccaggcccagggactgcagcctgagctccccgaggcccagggcagccgggtgaggactctgtcctgtgtcacctctctccaggtgtccagctgtctcatgcctttttgtcctgtcctcagctctccgtgtggtcagcgaaaccattgttttctgttaggactcagttgcaagaacagaaaccctgcccccacttaataataaaaaagaaagtttattgatgggtggttgcaaaaaaaaaaaa

SEQ ID NO: 440 - DNA, 833 bp, Homo sapiens
  CDS (258)..(467)
  misc_feature (1)...(833): n = a,t,c or g
cgtgccagctctcactgaacatgaaagcagtcgnaacccagaaaagtaagaaagttcaacgcaccttggnccgcctgagtcgacgcccgcgctcctgcgtattgctcctttnccacagtggactctgtggtcgccacatccttctcctgcatgtggcaagccaccgggccatgggctgctgaccgctctcgctggccttcgtgggtgcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaaaaaaaaaaaaaa

SEQ ID NO: 441 - DNA, 1241 bp, Homo sapiens
  CDS (350)..(553)
  misc_feature (1)...(1241): n = a,t,c or g
atgactggaaagtgcagaaagccccgaagctgatgctggtagtggaatctcaggcactgagtgtggcgagtctcaactggccactcccacggagcctggggaggcttcagcaagagccaagtgagagcaggtcagaggccgggcccagcgccagcgaggcatctggggagccgtgcccttgttagcgctgaaaatggaagcccctccattcaggcctggacagatgatgggcagcgaatgtgctcacatgctgagctgtggggctggactaggtaccaaaatcagggtagaacactgagacgtctgtgggcgggtgtgtgcacatccacacttgtacactcacattcacatgcacatatgtgcacacgcatgcaattcatacacatgcacagttgtgctcacagcctcgcacgcccttgcacactcgcacttatacacatgcatggtcatgctcacagcctcgcacacgccctcgcacactcatccacacacagctgtgcacaaggaacacagagcagatgttctcagagggactctgacacctttgagatgagggttttttaatcactggaaggctctcttgggtctaacaggttcagagaatgtaacacctggttttcaaaacatttttcaaagaaatagagaattcccatacacaggcatacgtgacgttatgaggccggtggaggcctcgctcggtgttgccctgtatggttgagctgtggtttaaggtgaactctggagtgtgggctgcangtgagggctccgtccctgggagctggtgggaggagctggaggctggcgccgccctgctcaaagctgcctgcttgggctcgtctgaggcggttccgagctgcaggtgtctccaccaacctgctgtgctacacagcggggtcctgggcagcctcaccactgcgtgtcttgggttcctcttctgtaaaacagaggctgcctccgaccctttggacaaacagggaagagccgtaacacgcaggatgtgaatggaaccttaagcttgtgcctgaagggtcgagctactggtggccgtgatgcctgaccgacgcgaggctcgtcggaaggtagggcacgatggcagactgagccctggtgtctatgaagcaccgagcaatgcgaggagggcagcagggaggaacgcggcacgcgagtggtgcagacacggagagaacacaacgatcggacgtcgctgagggatgtatgggacggtgagacttcactcagtg

SEQ ID NO: 442 - DNA, 1990 bp, Homo sapiens
  CDS (636)..(1202)
cctcgtagaccactagtccagtgtggtggaatgactaccatgataaaagaattttcaaggaactgaaatccagtgacaaaaatgaaatcgatcaaggctgtagttgcacacctgagacattcctcgagaaggcagaggagaaaggtgtgaaaaacagtgaaccagagaaggatggccagggacaacaaagattggagctcggaagttgaatgacagatattctggagaaacacaccagagatgacaaaagggtttgtcaaacacagcccaactcaactggagtcctgagaaggtgaccagaccaggatggaggcccagggaactcaccagaagtccccatgcatcagaacaaggtcgaagcatcctgacggagtctcgctctttcgcaaggctggagtgcaatggcatgatctcggctcactgcagcctccgcctcctgggttcaagtgattcttctgcctcagcctcccgagtagctgggactacagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagcctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagggtaaaacaaacaaattcatcttaaatcaggaacctttggaagaagcagaaaccttagctgtgtcatcaggatgtcctgcgacaagtgtttctgagggaattgatcgatcgatcctcagagaatcttttcaacagaatcagagcagggacaagatgagggacctcagggagggacagatggagccccccaagtctgaactcataggctggggaggaggagaaacttctaggtgggttcgagggggtgcgagcccacctccagccctcagccctcttttccgcataacttggtcagggcacaaggacttgaaggacttgaaagtcagggggttgagaggactggaggcgcctcgagtcaatgtctgggaaacagaggctaaccaggcagcctccacccctggacccccagcc

SEQ ID NO: 443 - DNA, 2146 bp, Homo sapiens
  CDS (690)..(1214)
  misc_feature (1)...(2146): n = a,t,c or g
cggaattcccnnacgacgatttcgtgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattgcaatgaacttctgaacatggtgtggaatagtggtaaggctgggggaatctatacagctgggctttcagtaggacccaaagatggtgggaaggctgaaggcctcaggaaaagaagccaatcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaaa

SEQ ID NO: 444 - DNA, 787 bp, Homo sapiens
  CDS (30)..(659)
taagcttgcggccgcacccacttcagataatgacaaagcaagggaaggagacaaacaaagagaaggaacaatttaggggacaagaagagaaaggggagaacaaggacagcaccttgacaaggaccccgctcgagccgctggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttccacctcaaataaaaattaagccatttcctattaaaaaaaaaaaaaaaaaaa

SEQ ID NO: 445 - DNA, 1635 bp, Homo sapiens
  CDS (327)..(986)
  misc_feature (1)...(1635): n = a,t,c or g
cccccccccatagaatacattgcataccncgagagcaggaantcccctcacaacacatgtcatgaccaaagacacacatacaagctccaaaggcttttgtcaggtaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctagcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccacttaagacttctgactccaatttaaaccaggaaagggatggggtggataccccattttgccctcccccatcaacacccagtcccagatccaaagcctcagtcttcaagtatggagttcaatgcncgcctccgcttggccaccgcaccctgctgctgttcccaagcttctcgccgctttaggaaggtagtcaaggccacatttccgac

SEQ ID NO: 446 - DNA, 1471 bp, Homo sapiens
  CDS (904)..(1293)
caaagagacccgggggacctccacgtcttcccagaggacccgatccgctgatctgtggcgccctggcttgcggggagcaagccaaggccaagactttggcctctccaataaaacctagtggctctttgcaggcccatagcctcaaagacaaaagatattttggctaggcgagcttgttcctcccgtcagcacaggaagcattcacgtctggtcatcactctagcttcagactcaaaagtgaacgattggctggctgtgagccgcaggaccctgcggggagaccagggtggtctctacactgttgggtagctagctggaggcaaggcgcttgtataagaaacagtccacggaccctgtcctgggcaggcagaattccgcggacaggctgttgtttcgcataagcagcacgggctgcggagacagaaacctacctgagtagtacggtgtattatatgagaacatccacttagcatagcaacgtctacggacaacccctgtagctcttcttctggattgttttctgtttcaaaccatgttttcttatttcctacgagtttatgtgcttggaagcgagcgtggtcgtgaaaaacccgtacccgctaaattcatctgggtccccaaagactgagccggctggcctcgttatttatgtgagcggctatgtaaatgaggattcggagattgctctattgattggagagagctggaggaggcggtctctcttccagagcgctagttgggagcggagcttgcctgtcattggtcgccagagccaatggaaaggggctgccgcgcggccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctccgccagcaaaggcccttttcatggtcgtcccgcaatgcttttgaatgtgctggatgtcatggagggccggtgacatctagcggggaggtgggcggcgagggtcccggcgggagccaataaagttggtgaaaatcgttaaaaaaaaaaaa

SEQ ID NO: 447 - DNA, 1662 bp, Homo sapiens
  CDS (152)..(1438)
ttttgattgtaagctggtacgcctgcaggtaccggtccggtattcccgggtcgacgatttcgtcagggcgcaggcgcgcgggtcccggcagcccgtgagacgcccgctgctgggcgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcgatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaaaaaaaaaaaa

SEQ ID NO: 448 - DNA, 2464 bp, Homo sapiens
  CDS (20)..(2320)
agaattcggcacgaggaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttcaaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaa

SEQ ID NO: 449 - DNA, 3382 bp, Homo sapiens
  CDS (341)..(3238)
atttggccctcgaggccaagaattcggcacgagcggcacgagtgccttttatgacatagacatttttgaagcgtgctggccatttatttcctatgatgtttcttgattggagttacatgatatttcctcatgattaggttatgctttttggccagaatatctcaggagggatgctgtgtccctctcggggttttaacttttctttcctcacacctagatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaaaaaaaaaaa

SEQ ID NO: 450 - DNA, 1609 bp, Homo sapiens
  CDS (77)..(1378)
gtcggtacgactcactatagggaatttggccctcgagcaagaattcggacgagggcggctggccggtgagcgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtaaaaaaaaaaaa

SEQ ID NO: 451 - DNA, 3856 bp, Homo sapiens
  CDS (105)..(1481)
acccgcgtccggcgccccggggagctcggagcgcgtgcacgcttttcatacggagaaggccagtgcccagcttgaaggttctgtcaccttttgcagtggtccacatgagaaaaaagtggaaaatgggaggcatgaaatacatattttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcacagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaaacaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 452 - DNA, 1546 bp, Homo sapiens
  CDS (404)..(1189)
cgctcctatagggaatttggccctcgaggcaagaattcggcaccagggagagagcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagagaaaaaaaaaaaa

SEQ ID NO: 453 - DNA, 1470 bp, Homo sapiens
  CDS (184)..(1014)
gcacgagggacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacaccatggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagcccagcatcagcggggtggaccttgataagttccgcgagattctcctgcgtcactgcgacgtgaacaaggatggaaaaattcagaagtctgagctggctttgtgtcttgggctgaaaatcaacccataatcccagactgctttgccttttgctcttactatgtttctgtgatcttgctggtagaattgtatctgtgcattgatgttgggaacacagtgggcaaactcacaaatggtgtgctattcttgggcaagaagagggacgctagggccttccttccaccggcgtgatctatccctgtctcactgaaagcccctgtgtagtgtctgtgttgttttcccttgaccctgggctttcctatcctcccaaagactcagctcccctgttagatggctctgcctgtccttccccagtcaccagggtgggggggacaggggcagctgagtgcattcattttgtgcttttcttatgggctttctgcttagtctgaaaggtgtgtggcattcatggcaatcctgtaacttcaacatagattttttttgtgtgtgtggaaataaatctgcaattggaaacaaaaaaaaaaaa

SEQ ID NO: 454 - DNA, 2539 bp, Homo sapiens
  CDS (97)..(1755)
tagggaatttggccctcgaggccaagaattcggcacgagaacacgtggagtccacgtaggctgtgttcggtccgagatgccttctagacatgcaggatgtcaaggaggcagctggagagatgggtctggagctcacagcaagtccaggctagaggtagaaacgtgagagccccacggctggggaagattgccatgggattggagatgagctccaaggacagccctggcagtctggatggaagagcttgggaagatgctcagaaaccacaaagtgcctggtgcggtgggaggaaaaccagagtgtatgctacaagcagccggcgggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctcaaaaaaaaaaaa

SEQ ID NO: 455 - DNA, 1875 bp, Homo sapiens
  CDS (196)..(1158)
gagattcgcacgaggtaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatgggaggaagtgtctcagtacacatgcctgtgcctgccctctcactgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaaaaaaaaaaa

SEQ ID NO: 456 - DNA, 3300 bp, Homo sapiens
  CDS (25)..(576)
taagcttgcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccagtgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctgggcaaatgaatgtgtttgttgagatattacagtaataaaacacttaagaacaggaagattacatttgttgggcctacgggaaccttagtggctacagaagaaagttgaccttgtgtcactatttattttatgccctgatcagactagccacttagataagtgaaagtttttctaacctgcccttaaaatatttggttttgtccaaagacccactttttctttagccttgtggtaggatttccattatttacttttatacta

SEQ ID NO: 457 - DNA, 3577 bp, Homo sapiens
  CDS (177)..(1835)
agtccggaattcccgggtcgacgatttcgtcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccactaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagatacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacacaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcat

SEQ ID NO: 458 - DNA, 1520 bp, Homo sapiens
  CDS (271)..(1161)
aggggggatttgtttcatcgcctgcggtaccggcccggaattcccgggtcgacccacgcgtccgctgcagccgagagtccagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaagctgcaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgcctgaaggacgagggcctgctcagctgccctgtcagccctgaagatatcgtgaacaaggatgccaagagcacactgcgggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggattctggaaaaaaaaaaaa

SEQ ID NO: 459 - DNA, 6223 bp, Homo sapiens
  CDS (59)..(4132)
ctcgtcgcctgcggtaccggtccggaattcccgggtcgacgatttcgtccacgggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgttaaaaaaaaaaaaa

SEQ ID NO: 460 - DNA, 6382 bp, Homo sapiens
  CDS (59)..(4291)
ctcgtcgcctgcggtaccggtccggaattcccgggtcgacgatttcgtccacgggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgttaaaaaaaaaaaaa

SEQ ID NO: 461 - DNA, 6304 bp, Homo sapiens
  CDS (59)..(4213)
ctcgtcgcctgcggtaccggtccggaattcccgggtcgacgatttcgtccacgggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctaggtaaggcttcggaagaggagatggcagagccaggttgggatggtgggtggagaacagatgattatcacttggtcaccgtagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgttaaaaaaaaaaaaa

SEQ ID NO: 462 - DNA, 1946 bp, Homo sapiens
  CDS (13)..(1404)
  misc_feature (1)...(1946): n = a,t,c or g
ggtggtnattgaatgcgttcacctgattacgccaagcttggcacgagggtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttttcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcattttgcctattaaacctctgctcttaaccttaaaaaaaaaaaa

SEQ ID NO: 463 - DNA, 2853 bp, Homo sapiens
  CDS (273)..(2648)
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcaggtgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctgggggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaaca

SEQ ID NO: 464 - DNA, 4648 bp, Homo sapiens
  CDS (452)..(3730)
tgtggggaaaaacaattgaagccgtatttgtaagctgtacgcctgcaggtaccggtccggaattcccgggtcgacccacgcgtccgcagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctataccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacacagcacgggctccctggagcccagggcagctttcagattgtgttcctccccaggagcagggaacctgtgtggcaggtgccccgggtactttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacaaaaacttgaagctgtttgtgatatgtacaactcagatgtttctcattaaaaaacaaaattagccagaaaaaaaaaaaa

SEQ ID NO: 465 - DNA, 1185 bp, Homo sapiens
  CDS (198)..(1133)
gaattcccgggtcgacgatttcgtgagcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgtcggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcagagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgctgtgtggctggcgggcggcatggcaggagcaatttcttgggggacagcgactcctatggatgtcgtgaaaagtcgactccaagctgatggggtttatttaaacaaatataaaggtgtcctggactgtatctcccagagttaccagaaggaaggtcttaaagtgtttttcagaggcatcactgtgaacgcggtgcggggcttccccatgagtgcggccatgttccttgggtacgagctgtcgctgcaggctatccgcggggaccacgcagtgacgagcccataagcgccaggtctttgctcaggctgtcccctctgcctgacatcctcttctcgct

SEQ ID NO: 466 - DNA, 907 bp, Homo sapiens
  CDS (240)..(779)
  misc_feature (1)...(907): n = a,t,c or g
atttggccctcgaggcanagaattcggcacgaggagagactttcgcttccggctgccgcacgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcaaaaaaaaaaaaa

SEQ ID NO: 467 - DNA, 1131 bp, Homo sapiens
  CDS (35)..(982)
agcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggagatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggaactctttactatgaagttaatagaacctaagaaggcatttgaaatagagctgaggtcaaaggctggaaagtcatcaggagaaaaaattggttgtggaagggcaacacttcgcctgagatcaaaaggtcctgccaccgtggaagaaatgccttctgaaaccaaagcaaaggcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttctttttttttctcttttttaaaaagtcctataagatctgtttttggacacctttactaactctggtttaatttcatgtgtatggaatatattctttgaaatataaaaaaaaa

SEQ ID NO: 468 - DNA, 862 bp, Homo sapiens
  CDS (226)..(612)
gcaaggatccttacttaaattaatcccccccccccccccccggccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagcaaaaaaa

SEQ ID NO: 469 - DNA, 3362 bp, Homo sapiens
  CDS (442)..(3108)
agaaagtgcattgaattttaatttatttaaagaattcggcaggtgccgcctaaggaagagaaagataaaaacaacgaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctggtagtatgccctacaatcttaacagaagatggcatgcaagctcagcacctgggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgcaaaaaaaaaaaa

SEQ ID NO: 470 - DNA, 968 bp, Homo sapiens
  CDS (125)..(736)
tcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtg

SEQ ID NO: 471 - DNA, 1111 bp, Homo sapiens
  CDS (133)..(1032)
atttggccctcgagcagtaattcggcacgaggggccagaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccaaaaaaaaaaaaaaa

SEQ ID NO: 472 - DNA, 1097 bp, Homo sapiens
  CDS (84)..(764)
tttgttagattgcgttgcagtaccggtccggaattcccgggtcgacccacgcgtccgcgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagaaaaaaaaaaaa

SEQ ID NO: 473 - DNA, 2695 bp, Homo sapiens
  CDS (256)..(2253)
  misc_feature (1)...(2695): n = a,t,c or g
tcataattgtcaaaaaccagaattaggtcaagttcatagtttctgtaattggctttgaatcaaaggggcaccagggttagggggttacggggagtatgtgagtaacgcctgctttggaacataaaccccctcccccgcccccatgtgcgctgtgacccacgccctcgcagtcctttctctggaatcatccatgcgcccctggagcaagctggggcgtctgtgaaggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtgctgcccaggctggccggggtagccctgacgcaggctgggggtactgtcccttcaagaggggctggggcagcagaggatcactggcagtccctgcctggaggaggggacatgtgtatctgggcttctcacggggccagttctgtagccagggcgtccgtgagggaaccccaggggaacaagtctccaaggatgaataccaaacgggctggggagtgcctatgtccacggtcttgttccttctcagcccaggattatgacatcttcgcccctattttacctgtggagaagcagaggctcagggttacccaggaagtcagggcagggttggtgctggtgctgaagattagacctcagaccaactcttgtatcctgcctttgccccactccactggttctataaatagcgaccatgtacctactaaatagcgggccccgcggtgattaccctgtgatccttgtgatgcttgagtagctgacttagggcatcctcagcaccgatgggcttggtggtttcccctgactcgggcctccttgcagtacctctttttaccaccaggtggggctcctgtacgaagagggtgttcgcaaggcccagagcagcgactccagcaagaggactttctccgtgtacagcagctctcggcagcagggccgctacgcccccagctatacccccaagtgccccgatggacaccaacctcttgagcaatatccaagaagctattctcngaacgtattgatgtgttcaagccctgtggagttcaacaaggtgtcggtgctgaccggcatcatcaagatcagcctgaagacgctgctggagtgtgtgcggctgcgcacctttgggcgcttcggggctgcagcaggtgca

SEQ ID NO: 474 - DNA, 3063 bp, Homo sapiens
  CDS (128)..(2791)
actcttcgagtaccggtccggaattcccgggtcgacccacgcgtccggtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgtgaaacgaagttctaatttcatgtacctgatgggtggatttcgatgtgtcaagtgtgatgataaggaatatggtattgtttattatgaaaaggacggtgatgaatcatctccaattttaacaagttttgaattagtgaaagttcctgacccccagatgtccctggagaatttagttgagagcaaacaccacaaccttccccggagtttaagaagtggaccttctgaccacgatctgaaaccctatccttccccgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaaaaaaaaaaaa

SEQ ID NO: 475 - DNA, 3302 bp, Homo sapiens
  CDS (98)..(2563)
atttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatgaagtatctctacagggtagtaacttgattcctcttcaggagaaaagggagctaaattgcaagctctaactaagggtttctgctactgacatcacaacacagaaatgcaagtgtggtacttccagtgaaagcacatggcacctttctaggtgtgtagccactgagaagggacagtgaaactgttatttttgatatcagaatgtcatttttatgtgcatatccctaaaattagggttatttctacatacactagttacacttgtgaattttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaaaaaaaaaaa

SEQ ID NO: 476 - DNA, 776 bp, Homo sapiens
  CDS (405)..(755)
  misc_feature (1)...(776): n = a,t,c or g
attggagaaactgagcggcnattgccaacnaccatnngaaaataataatggtgtggccaattcaagcgatgcaatggatgcaagctgcaatcggaatgcatggttaagcctgaagaaatgtttcctgtaatggaagatgggaaatatgtcgataaatgggcaatacgaacgacggcaatgattgccagagaacttggtaaacagaacaacaaagctgcctgatagtggcctttatttttggcataaataacagaataaacactgcactgtgtattcattccaacgagtgaatacacggagcaatgtcgctcgtaactaaacaggagccgacttgttctgattattggaaatcttctttgccctccagtgtgagggcgattttttatctgtgaggatatgaacagatgtcaaacatcaaaaaatacatcattgattacgactggaaagcatcaatagaaattgaaatcgaccatgacgtaatgacagaggaaaaacttcaccagattaataatttctggtcagactctgaataccgactcaataaacacggctctgtattaaatgctgtattaatcatgctggcgcaacatgctctgcttatagcaatttcaagcgacttaaatgcatatggtgttgtgtgtgagttcgactggaatgatggaaatggtcaggaaggatggcctccaatggatggtagcgaaggaataagaattaccgatatcgatacatcaggaatatttattcagatgatatgactatcaagcctgcagcgtggt

SEQ ID NO: 477 - DNA, 1298 bp, Homo sapiens
  CDS (138)..(629)
gctcgagatccagaagggaagatttattactaccatgtgatcacaatgagacagagtctttctttgttgcccagactgatctgcacgaactcctggcttcaagcgatcctcccacctaagcctcccaaaatgctgggatgacaggcgtgaggcaccacacccagctacaactgcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaattgaactcatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaacactttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaaaaaaaaaaaaaaa

SEQ ID NO: 478 - DNA, 1640 bp, Homo sapiens
  CDS (403)..(723)
atagaaacaccttgactgtgaacacgttaagcttggcacgaggagccagagaaggctctctgtgttgaacactcctgtgattccagtggctgcacccagatcctccgggccgtttcccctcccttaaggattcctatgccatgtaacagcacaggcatgggtgtgatctcacgtgttcacagcttccgggggctaggatgagacatgcttgggggcgggggccacttaaaaatgtgcctgcactgtgggcgtgatgctctgcactgtggaaggaaaaggagttaaatgagaaatgatggtgggcgctgagcctgagcagcgccgctttgtgccgcagcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctggaagccaccctgagggcgggagaactctcctttttcaccaggaccgcctggctagccctcaccctggcgctggccttcctcctgctgatcagcattgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaaggagccaccaggtggtgtgtggattctgaaaaaaaaaaaaaaa

SEQ ID NO: 479 - DNA, 3627 bp, Homo sapiens
  CDS (590)..(3412)
cctgtaggtaccggtccggaattcccgggtcgacccacgcgtccgcggacgcgtgggggcgcggagcccgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttctggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaacgtagaagttacgcgcgtaaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagaga

SEQ ID NO: 480 - DNA, 4226 bp, Homo sapiens
  CDS (1)..(2982)
atggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcacccaacattgaatttcagatggcattgccagagaaagttgttaacaagcaatgtaaggagtgtgaaaatgtaaaagaaataaaagttaaggaggaaaatgaaacagagatccaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtaaaaaaaaaaaaaaaa

SEQ ID NO: 481 - DNA, 6765 bp, Homo sapiens
  CDS (259)..(3105)
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacagtgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcaaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaacgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatgacttgaattgtcatcattctttttaagatatttagttaaactgacttaatgtatggccttcaatttttttgtgtccttatttttctgatcatttctccttttatagtttacattaagtctgatctcatattaattacattttctcatctgttgttactaataaacatggcataatgttacttacaaatgtattatctacaagtagtgctatccacaaatatattcaaatgttcccttttaatgtttgtcatttttttcatgtgttgttaatgattcttccatgtgataataagcagaaatgacaataaacttttcatagtttctgattttaaggaaaatgcctccagcatgatattgaatatttgattctgaaaactaaagactctttaacagattaggggattgcctactttttaaaaagtttttatttataatatgagtatatgtaaaattttaaatagatcttttacatggacatgattatttgtttctatttgatataccactacaatatattgacagttttcctgctactgaatcaatacttataatggcaaataatttaactgtttgttatattctatgtatgctgtatgtaatttttacatctacacatttaagtaactttagctgataccgttatatttgtcagattttaagattagcaccataattactcatagaagcaactatgtgaccccatctttttcatgacatatttatgccacataagaactgagtgttcaacagttagagtcatctttaaaccttcagtagaaggacagtttgaaaatcattgcaatattttcttcagtctttttttaggttttgtgaattacgcagtttaatatttttgtttaatcttagaaaattgttgtacatagtgtttcctaataatttatttgtgctctgtactgattattgtattttctcacatttatgttaaattttattagtaagattattttctctatttatcagttttgtaaaatgttaaaaattcataaaagccaactgactattggctttaaactaccaataatttagttgatctctatattattatattactctgttaaaatttaattgtattttttgtaaggttttttttcctcttttatatttgctagtattttataaagtatttgttatttcaaaagaaacaactattggccagttaactttcatgccgctattttcatttcctggtatgcttattgctactttgtttttggtggctaccttattaaaacttttagaaatttcagttt

SEQ ID NO: 482 - DNA, 866 bp, Homo sapiens
  CDS (42)..(749)
ggcacttactccctgagctaagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttcccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagcatactagt

SEQ ID NO: 483 - DNA, 2472 bp, Homo sapiens
  CDS (44)..(1771)
atttggccctcgaggccaagaattcggcacgagcactgtaactatggccacaaagaaacatttctcaattatattaaatcttctgggaatgttacttaagaaagataaccaggacacgaggaaactgttaatgacttgggctttggaagtagctgttgtaatgaagaagtccgaaacatatgcacctttattctgtcttccgtctttccataaattttgcaaaggccttttagccgacactctcgttgaagatgtgaatatctgtctgcaggcatgcagcagtctacatgctctatcctcttccttgccagatgatcttttacagagatgtgttgatgtttgccgtgtccaactagtgcaccgtggaacttgtattcgacaagcatttggaaaactgttgaaatcaattcctttaggtgttttcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacagtgatgaaggccatggtaacaaccaacttagacttgttcttcttctgcagtatctggaatatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaattttgctttattgaggtttatattacacattctaagtgtatggtttgatgagttctaacatgtcttcacttgtgtgaccaccaatacgatcgagatacagaacagcgtcttaccccagaaggttcccttgagatcatctcctcatttgcccctgtcagcagttactgatttgctttctgtcactatggattagacttgtctttactaaagtttcatgtacgtgaaatcattaccaccaaa

SEQ ID NO: 484 - DNA, 1276 bp, Homo sapiens
  CDS (331)..(930)
acggactcctcggtcgacgatttcgtgtccgtgttatatcatctggtctcattgataggcgggatatggagggggattccagcccccctggaccggccggaggtttattctagagttactggcgggtagctgtgcttttctttcccgtttgtaggtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaaaaaa

SEQ ID NO: 485 - DNA, 1826 bp, Homo sapiens
  CDS (755)..(1726)
ccggtcaggaattctcggggcgacccacgcgtccgctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaaggggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatga

SEQ ID NO: 486 - DNA, 632 bp, Homo sapiens
  CDS (67)..(486)
atttggccctcgaggccaagaattcggcacgagcaattccgaagagctgcccagaaggagagaacaatgtcatcactacccgtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttgagagatatctccctgaccagagtgcttatcagcgattgagggagatgatcagactcctcattgttgaggaatccctctttctacctgaccatgggattcccagagcctactaacagaataatccctcctcaccccttcccctacacttgatcattaaaacagcaccaaacctcaaaaaaaaaaaa

SEQ ID NO: 487 - DNA, 2102 bp, Homo sapiens
  CDS (309)..(1283)
attgaacgcctgatgtaccggtccggaattcccgggtcgacccacgcgtccggggggaggcgcgtcgcgaggcgagcgtcctccttttgtgcgagcgccggcggctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaaaaaagtcaaaatgcaaacttaaaactttaaacaaaagtattactaatttaaaaaaagtttgtgttgggtaccgtcgacgcggccgcaagtttagtagtagtagtcgacccgggaattccggaccggtacctgcaggcgtaccagctt

SEQ ID NO: 488 - DNA, 1925 bp, Homo sapiens
  CDS (755)..(1585)
aattgaacgtgtgaggcaccggtccggaattcccgggtcgacccacgcgtccgccacttcctgttgtgtcacacttgcctgcagtaacatgctgtaaggtttgtggcataggagcagtgggccataccatataatcaaggtgtcacatcccggtggctggacatgccctcttgggcttggcagatgccagtggatccatacaactgctccgcctggtggaatctgaggtcagtgacttgcacttgttctgtggggcagaagggacctgaatagagagggttggggaggaggctgtgctgatacagacatttttctaaaacgatctctcttcaatggtgagctatatataaacgttctaagataatgtggagtctatttttaagttgtattgcgttctacatccaactccaagaggaagtcacctcatgtgtcaccagcagaagggctgaagtgacaggatgttcattgacctgtcagtggatctgaaagttctctaaggagagcctgggcaagcattcttaggttgatgctggggcccagagtagcagtgagcatcctgtgtgaagatggcatttctcactgattattggaaaagcactagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttgaaaaaaaaaa

SEQ ID NO: 489 - DNA, 1596 bp, Homo sapiens
  CDS (42)..(542)
  misc_feature (1)...(1596): n = a,t,c or g
atttggccctcgaggccaagaattcggcacgagcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggaccgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaagtagaagtgctagaaatatctttgtgtattaacatgcaataaaaggtaccattcaaagacagggggaaaggtaggaagaagaggtaatttttacttgaaaattagggcatgttggtcgccattttattaaaagcttttttttaagcttttcataaagattgcctttttgctatttttntgaaatttgggtattnataggtttggtagggtnacccggtccaatnatgacagtnctactgncttaatataggagactagggggtaaccaggtgtgttttacataggggttg

SEQ ID NO: 490 - DNA, 1553 bp, Homo sapiens
  CDS (135)..(821)
aattgctgctcgcgtacgtcagcttggatcctctagagcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctcttttggcagtcttgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaaaaaaaaaaaa

SEQ ID NO: 491 - DNA, 4964 bp, Homo sapiens
  CDS (167)..(2452)
tttgatagcctgtcgcatgcgctaccggtccggaattcccgggtcgacgatttcgtgccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaatttttttttattcttatgctaaatcataggagaaaaatctagatggcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccac

SEQ ID NO: 492 - DNA, 4892 bp, Homo sapiens
  CDS (167)..(2380)
tttgatagcctgtcgcatgcgctaccggtccggaattcccgggtcgacgatttcgtgccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaatttttttttattcttatgctaaatcataggagaaaaatctagatggcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccac

SEQ ID NO: 493 - DNA, 1233 bp, Homo sapiens
  CDS (85)..(915)
atttggccctcgaggccaagaattcggcacgagcaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaatgcccaggtaaaaaaaaaaaaa

SEQ ID NO: 494 - DNA, 3001 bp, Homo sapiens
  CDS (1361)..(2419)
ctgctattccattctcccatctactacctatctgttcttcaggccatccactcatccattcttctgtcccaggtacctagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagt

SEQ ID NO: 495 - DNA, 1434 bp, Homo sapiens
  CDS (138)..(1418)
acccgtccggaattcccgggtcgacccacgcgtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgcg

SEQ ID NO: 496 - DNA, 2106 bp, Homo sapiens
  CDS (81)..(524)
gcacgaggcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtatacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaaaa

SEQ ID NO: 497 - DNA, 1140 bp, Homo sapiens
  CDS (97)..(606)
gggtcgacccacgcgtccggcggagggacggaccagctttaactctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtggtaggtggtaggtggtagggtgaggggatggtttgtgcttaatttgttttgaattaaatctgtgtatgtctgatgtaatcacaatctgcacataacattcatcattgaattttctatgccaagtcattaagtggcatttggaaagtagattcttcatcttttatctgtaatttaaaaaattgaggcataattgacattcaataaaatgcacagctcttaatggttcagtttgatgagttttgagaaatgtatataaccaacacccaaatcaagatacagatttttaccatttcagaaagctctttcatttcccaatgagtgtgttttactgtgtgtaatttattcatctataaagttggttaaaaactatctatgagatactttatttttcttagacaggtatgcacctgtagtcctagctacttgaaaggctgaggtgggaggatcgcttgagcccaggagtttgaggctgcagtgagctaggatcatggcactgcactcctgcctgggtgacagagcgagaccctgactctaaaaaaaaaaaa

SEQ ID NO: 498 - DNA, 1279 bp, Homo sapiens
  CDS (762)..(956)
ttttgcacgagggcggggtgtgcttagcgttgataacagaagattctgagatgggtgagaagtggtccacacgtggccactgtcattcctctggcataatggacttgggctcaggaggtcaagccctcttcaaggagcatgagctgaaattgctaaactttgggagttttccgtgacacccttcaaagtgctcacggtgtggcatggatcagctggggagggttgatgtggttttgccctgtggggtatctatctgtgtacttttgtctgagggaggcaactggggccacttaggccggcaggtgcccactgtgattggttgacatgataccaagcaacaggatcatccagtcaccttcaatgcagggaggatggctgacaggctccctgggtgacacttcatgcaatcagatgtcgagttggactgtgacatagagccatgtggccacactaaattcccccccacccttcccctgtccacaaccgtcattgtctgttcttgccatccagtggccactgcctccaccatggctgaggctttctctaagacaacctctgaggaagaccagagcatccaggagcccaaagaggccaactccatgacggcccagaagcagaagaagtgagggcttcgaggctcccgtaggcgccatgccaacagcggcggagatatcttcggggacagctttgccgcctatttcccccgggtgctgaagcaggttcaccaggccctcagcctttcccaggaggccgtgagtgtcatggattctatggttcgtgacatactggaccgcatcgccaccgaggctggtcacctggcccactactccaagtgcgtgaccatcacctcccgggacattcggatggccgtgtgcctgctgctgccggggaagatgggcaagctcgctgagtctcagggcacgaatgccaccctcaggtacaccaaaagcaagtgagctatctcaggagcgcccgagcacccgggaaagccaaatgctctgttcagaaccaccacacgtggccctaaagaccagtggcctgccaaggaggggaccccactggagattggggtgggtggcaccgttctggcttggggagcatgtggcgtgtggccttctgcggtttttcaagcatttttcccacagtgcaaaacactgtcaactccaatacatctgtagtgcaatatgctccaaggaaaagtagggggtgtttccgtaatcgtgtttcatgtcctcagtttcctaaatggccgttttatcagttatctttctaggctatc

SEQ ID NO: 499 - DNA, 1751 bp, Homo sapiens
  CDS (710)..(1585)
ggtggaattcggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggcaaaaaaaaaa

SEQ ID NO: 500 - DNA, 1033 bp, Homo sapiens
  CDS (156)..(905)
  misc_feature (1)...(1033): n = a,t,c or g
aaacacccttggggaggattgatcaagaaaataatgaaaccaagccaagcttctgnctgagnccaaactctgttgaccaccgtgaagttcaggtcttaagccaaagcatgccactcactccgcaccaggcagtncctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaata

SEQ ID NO: 501 - DNA, 1204 bp, Homo sapiens
  CDS (445)..(1041)
taagctggaccgcattttttttttttttttttttgaggtagaaaacttttattagctggagaggttgaggcctacagcggggaaaggacttgccagattttcgccgcaagtcagggccatagcggggggcataacaaggcctcccaaccgaacgtcaagcaagagctccgagcgtcccacacaagtcccgaacgactcgttgacgccgcgctactgaaggcgcctgggttcccggactcggccaccgcctcgccgcttccgcccctcagaagcatggccgccacgtagcccggcccggattggacgttggcggtggacgcaaaccagttggcaacacgattggctgctgcggggtgatgacgtcagggggcggtgtcggagtgaatgggggcagcatgaggccgggcggcttttttgggcgccggacagcggctgagtagagccatgagccgatgtgttttggagcctcgccccccggggaagcggtggatggtggctggcctggggaatcccggactgcccggcacgcgacacagcgtgggcatggcggtgctggggcagctggcgcggcggctgggtgtggcggagagttggacgcgcgaccggcactgtgccgccgacctcgccctggccccgctgggggatgcccaactggtcctgctccggccacggcggcttatgaacgccaacgggcgcagcgtggcccgggctgcggagctgtttgggctgactgccgaggaagtctacctggtgcatgatgagctggacaagcccctggggagactggctctgaagctggggggcagtgccaggggccacaatggagtccgttcctgcattagctgcctcaactccaatgcaatgccaaggctgcgggtgggtatcgggcgcccggcgcaccctgaggcggttcaggcccatgtgctgggctgcttctcccctgctgagcaggagctgctgcctctgttgctggatcgagccaccgacctgatcttggaccacatccgtgagcgaagccaggggccctcactggggccgtgacactagtggccatggctgcctgcctgactgtagtgcccaccaacccagccactgccacagagctgccacgccagccttggtatctactttttatacaaatctcctctagactgttccaggctgcctgcggattaaagtgggggtgactgtgaaaaaaaaaaaa

SEQ ID NO: 502 - DNA, 2208 bp, Homo sapiens
  CDS (88)..(1956)
cgatatttccgggcagacccacgcagccggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcagggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccaaaaaaaaaaaaaaa

SEQ ID NO: 503 - DNA, 1282 bp, Homo sapiens
  CDS (266)..(793)
ctagtataccgatacgccagctggctagcgtttaaacttaagcttggtaccgagctcggatccactagtccagtgtggtggaattcccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcataggggccagcggtttctcggaaagtagcctcttctgcaagtggggcattcacacaggggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacatcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacaggtgtctgcctcctgacccttccatccttcaggtgtcctgttgccccctcctcccactgacaccctccggaggcccccatgttgacagaccctcttctcctaccttgtttcccagcctgactctccttccgttctgggtccccctcatctggtcggctcccctgtgtctcatcccccgacgaaatcgtcgacccgggacacgatggcc

SEQ ID NO: 504 - DNA, 400 bp, Homo sapiens
  CDS (223)..(399)
gccctggtgggaaaagtccacaatttcccattgatagctttttactgcagagaaaaagggaagcgtcagccacacaaaagcctgcgtgaccgctgcttcggagaagctctcgaccctaactgcagtcactgttacttggatcagatcaagcgcagagactttttgggatccagtggttattctccacacttcggagccatttcaaccaactctgagcacaaaatgcagccatcctctatgcagcaggccctgcccagtcagcgaccctactggacagatccaaggccagccctggttccctgctgcagccaccgtcctgacgttcatcggagcaggccggggcctggccttcccggcacaggaggctgttctgacaggcccccagcttgtcccatctgat

SEQ ID NO: 505 - DNA, 1025 bp, Homo sapiens
  CDS (77)..(775)
attacaccagcgtggtggaattaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagaccacgctcctctgccttctcctggcctgggacacacagagccaccccggccttcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttcaaaaaaaaaaaaa

SEQ ID NO: 506 - DNA, 649 bp, Homo sapiens
  CDS (130)..(516)
caagcctaataccgactcactatagggaaagctggtacgcctgcaggtacggccggaatcccgggtcgtctactactactaaattcgcggccggtcgacgtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatattcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaaaaaaaaaaaa

SEQ ID NO: 507 - DNA, 1861 bp, Homo sapiens
  CDS (186)..(1832)
ggaactccctgtattgaggaagaaattagactagttggcttcaaagatctaggggaatgacatagaccgcatttatgttgcatacataccactacattctattcccatgctcatggcaggccttactaatcaatcatagaactttatccctgtgagaccatcatatattaaaggcagccagcaccatgttggagcacatgcaatcccatgcagctgacaatgaaaacaacattgcctccaaccagtcccgatcgccacctgctgttgtaaaaaagaagaggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaaaaaa

SEQ ID NO: 508 - DNA, 1349 bp, Homo sapiens
  CDS (296)..(994)
agcgccccatgaattcgaagctgtacgcctgcggtaccggtccggaattcccgggtcgacgggaggcaggagaacggaagctgggagcagggaaagccttttgtcctgagcttttctggcaagggactttgcatattggttttgcatctcatttacttctccattggttcaggataaagatggggaatcccctcctctccaaacctgcccccaaacccttccttcttgaaccagaactctcctctccccggtactccttcctggaccgcgctggaagccctggcggcggcggcccatggggcccttggcgctgcccgcctggctgcagcccaggtataggaagaatgcgtatcttttcatctattacttaatccagttctgtggccactcttggatatttacaaatatgacagtcagattcttttcatttggaaaagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaataccttgtatttgataaaaatccattacatgaaataactgcacatacccccaaaactctagacataacaggctatgtttttcacacattgtatttttaagacatatatattctccataccctgcttcaccaaaattcctgcttcatttggattttatacaagttatacttacattgtatgaagtctgattattttcctgtaagtttaatgagaaataggagattagctgcaatagattcaattaaattaagaaaccaaaaaaaaaaaa

SEQ ID NO: 509 - DNA, 1397 bp, Homo sapiens
  CDS (155)..(1258)
  misc_feature (1)...(1397): n = a,t,c or g
ccggaattcccgggtcgacccacgcgtccgctattttgttggttttgtttcggctagctagatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtggggaagaggaacaattagtactcaggacatgatgggcttgctacattgtgttaaaggaactggggctttngcctattccaaatgggtctgtgggantttacttnggggaaaaactggttttggaaacttttccacaggttcttcaggctttttccntcttgggttgttttt

SEQ ID NO: 510 - DNA, 1562 bp, Homo sapiens
  CDS (521)..(1024)
caagtatttctttagagcaatgcaaagaatggtctaacacacccggaaagctgagactggcatgagtataaagatcgtggataattttgaaatctaaaaatgtaaaattaatattattgagggagtcaacacaggaaagattagagcacgtgggcagaggctgttgcccattggtcacatgtggtcagcagagagcaggtgaccagcaccctggagctttgcaggaagaaccagacagcctggagctgaggttttaattgtaggggccaaaacaaatggggaaaaagacaaatttagaaaacaaagaaagtagatgctcaactgagccagaaggaagtcactagcaaagaggaaaaaaatagagctctggaaaaatagtgtaaacagtcacaagaaagggaccctgtgtcatgcctgacatctggacaggtatataaagagcccaggctcagggagctccacacctgcacctccctctcacctgctcctctacctgatccaccctcaatccaccagaaccatgggctgctgtggctgctccggaggctgtggctccggctgtgggggctgtggctccagctgtgggggttgtggctctggctgtgggggctgtggctccggccgtgggggctgtggctctggctgtgggggctgcagctccagctgtgggggatgtggctccagatgttatgtgcctgtctgctgctgcaagcccgtgtgctcctgggtgccagcctgttcctgcaccagctgtggctcctgtgggggctccaaggggggctgtggctcctgtgggggttccaaggggggctgtggttcttgtggctgctcccagtccagctgttgtaagccctgttgctgctcctcaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatccgtgcgttcttcctgccccggactcgccacgaaatcgtcgacccgggaattccggaccggtacggcag

SEQ ID NO: 511 - DNA, 2907 bp, Homo sapiens
  CDS (359)..(2530)
  misc_feature (1)...(2907): n = a,t,c or g
ccctttaaatagtatcgctcccccaccgagcgagccaaaggatcatgacgagaacggagaggccatcacccttcttccccccggcgtggcgatcattatgcagtgcacgcagttttccgactgaaagcggcaagtagcgcaccatattatgtagttagtcatcataaggcaccaggncttacactatggctcnggctcgtatgtgtgtggaatgtgagcggatacanttcacacagnaancagtaatgacatgattacgattttatacactcactataggggaatntggccctcgaggccaagaattcnggcacgaggggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattgagccaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagtggtgtaaaaaaaaaaaa

SEQ ID NO: 512 - DNA, 794 bp, Homo sapiens
  CDS (88)..(486)
cattactcactatagggaatttggccctcgagcagcacattcggcacgagcgcttccacccggaaagccccccaggctgagtgcggcatgatctccatcaccgaatggcagaagattggtgtggggatcaccggtttcggcatcttcttcatcctctttggaacactcctgtactttgattccgtgctcctggcctttggaaacctgctgttcctgacgggcctgtccctcatcattggcctgaggaagaccttttggttcttcttccaacggcacaaactcaagggaaccagcttcctcctggggggtgtggttatcgtgctcctacgctggcccctcctcggcatgttcctggaaacctacggattcttcagcctctttaagggctttttccctgtcgccttcggcttcctgggcaatgtctgcaacatccccttcctgggtgcgctgttccggagacttcaaggcactagctcgatggtctgaaaaacagagatgagctccttgaacttggatcattggttgagggggctagagggagaatgggaaccaccccctcagtcccctgcactgactcactccccgacatatccggacctccccaagtccagaaggaaggaatggagctgagcaactgacgtcaaatccccaagtcgactcaagaggctgccaggaagcagagatgcagaccccaaggagactgggctggggctggtatcacaccctcactctatatttatgggaggaaaagtgaagattaaattcccaagttgtgcgtgtgaaaaaaaaaaaaa

SEQ ID NO: 513 - DNA, 1968 bp, Homo sapiens
  CDS (261)..(596)
agatcactagtccagtgtggtggaattccccggacctgcccacgctgcgtgccaagttgcagggactgctgcagttcctgagggatgccctgtccatttccaatgcacataccgtggatttctacacagaatccgtgtgggaggagctggtcgacttgccaccggagacagtgctggctgcgctgaggaagtcagcgtcggagacggaggccctgccctcagagacgcgccccctagtggaagcagagtgggaagcaggtatgactgattttcccaaaatattttgtgaaacttctcacaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgattagcagtattgctgactactatggaataaagcaggtgattgacttgggttccggtaaaggctacctaagctcttttttgtccttgaagtatggcttataagtttatggaattgattcttcaaataccaatactcatggagctgaggagagaaacagaaaattgaagaaacattggaaactctgtcatgctcagtcaagattagatgtcaatggactagcattaaaaatggcaaaagaaaggaaagtgaaaaataaagttaaaaataaagctgatactgaggaagtgtttaacaacagtcctacaaatcaagaaaagatgcctacctcagctattttgcctgatttttctggctctgtaatttctaatatcagaaaccaaatggaaacccttcattctcagccacatcaagaagaaaatttgtgttttgaaaattccttttctcttataaaccttttgcctattaatgctgtagagcctacttcttcacagcaaatacccaacagagaaacatctgaagccaataaagagagaagaaaaatgacatcaaagtcaagtgaatcaaatatatattcacctttaacctcttttatcactgctgattcagaactccatgacattattaaagatttggaggattgtttgatggtgggtctccacacttgtggtgatctggctccaaatactttgcgaatatttacctccaactctgaaatcaagggagtttgcagtgtgggttgttgctaccacctcttatctgaagaatttgaaaaccagcataaagaacgtactcaggaaaagtggggatttccaatgtgccactatttaaaggaagagagatggtgctgtggtcgtaatgccagaatgtcagcatgtttggcattggagcgggttgcagctggccaagggctgcctactgaatcactcttctatcgtgctgttcttcaggatattattaaagattgttatggcatcaccaaatgtgatcggcatgttggtaaaatttattccaaatgttcttcttttctggattatgtcagacggtctctaaagaagcttggattagatgagtccaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacaaaaaaaaaaaaaaaa

SEQ ID NO: 514 - DNA, 1748 bp, Homo sapiens
  CDS (157)..(771)
atacccctgcggtaccggtccggaattcccgggtcgacccacgcgtccgcggacgcgtggggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttaaccttcctgaccttcacttacctcagctatcttggtatcctaccctcatggagttgcagataggattctcgaaaatttcttacagcataacacccatgccactgtggtgtctggacgtattatatctctaagttttagatgtttcatccatgtaccttatatgcccatagcactatacttacattcacttgcatgacctatctaatttcttattctccaaattttgtgttagtaatcttcctcagcttctatat

SEQ ID NO: 515 - DNA, 1976 bp, Homo sapiens
  CDS (47)..(1336)
gggcgaggagggcgcgtcgccctcttttcccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagacagcctt

SEQ ID NO: 516 - DNA, 1823 bp, Homo sapiens
  CDS (114)..(800)
ccgacccactcgtccgggccttccagggcctcaagcggttgcacacggcgcacctgtactattacgcgctgtagcgcgtgcccagtggcctgcctcgccgcgtgcgcgccttcatgatcctgcacaaccagatcacaggcattggccgcgaagactttgccaccacctacttcctggaggagctcaacctcagctacaaccgcatcaccagcccacaggtgcaccgcgacgccttccgcaagctgcgcctgctgcgctcgctggacctgtcgggcaaccggctgcacatgctgccacctgggctgcctcgaaatgtccatgtgctgaaggtcaagcgcaatgagctggctgccttggcacgaggggcgctggcgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggatgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtgaaggcaggattggaagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctaaaaaaaaaaaaaa

SEQ ID NO: 517 - DNA, 6027 bp, Homo sapiens
  CDS (1)..(1650)
atgcaagctaccaagactgaatcaggaagaaatggaaaacctggacagcccagtaacaggtgtcattatttgcttaatcaaggctgggttgctaactctgggaaaggaggaagaaccaacattccagataaggagcttaaatctggagatgacccagaaaatgttcacatcacttcctttcaatatttggccttagctgccttcccacggggcagggctcgggacctgcagctcgccatgactgagcctccccacccctccgtgggctcctgtgcagcccgagcctccctgacgagcgctgccccctgctccacggcgcccagtcccatcaaccacccgaaggctgaggagtgtgggtgcacggcacgggactggcaggcagctccacctgcagcccgggtgcgggatccactgggtgaagccagctgggctcctgagtctgagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaaaaaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttgctgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 518 - DNA, 787 bp, Homo sapiens
  CDS (249)..(464)
ccggaattcccggggcgacgccggcgtacgataaatacccttgaataaaatggttagctttcttctcacagaggaagatgcagtatatggtggttgtagaaataaatgaagctttactttaagttctgggatacatgtgcaggatgtgcaggtttgttacataggtaaacttgtgccatggtggtttgctgcacctatcaacccatcacctaggtattaagcccagcatgcattagctatttttcctaatgctctccttcccccacctaaccccccaacaacccaaatgcccatcaatgatagactggataaagaaaatatggtacatatacaccatggaatactatgcaaccataaaaaggaatgagatcatgttctttgcagggacatggatggagatggaagccattatcctcagcaaactaatgcaggactatatgttctcacttataagtgggagctgaacaataagaacatatggaaacagggaggagaacaatatacactggggcctgttttgggagtgcagtggaggagaagagcattaggaagaatagctaatgcatgctggtcttaatacctaggtgatgggttgataagtgcagcaaaccaccatggcacatgtttacctatgtaacaaacctgcacatcctgcacacgtaccctggaacttaaaaaaacaaaataaaataaagtgggtataaataccactgccgaactgcctctgggctgctattttgggtccagtcctatgcatggccctctctgcaaggaacagtacctgtgc

SEQ ID NO: 519 - DNA, 1388 bp, Homo sapiens
  CDS (37)..(963)
atttggccctcgaggccaagaattcggcacgagaagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtat

SEQ ID NO: 520 - DNA, 1562 bp, Homo sapiens
  CDS (37)..(1137)
atttggccctcgaggccaagaattcggcacgagaagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcgagacggtgtttcactatgtttcccagtctggtttcaaacttctggcctcaagcaattcccctgcctcaccctcccaaagtgctgggattacaggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaagcttgttgcagggacgtgtctgcagcgcctggggaaccgagctgtccttcccctgtgcgggcgggcaccgcctcctcctggattgagtttgtgacgggcaccaaaaaaggcaccacgaccaacgccacatccaccaccactaccactgccagcaaagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtat

SEQ ID NO: 521 - DNA, 1340 bp, Homo sapiens
  CDS (37)..(915)
atttggccctcgaggccaagaattcggcacgagaagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtat

SEQ ID NO: 522 - DNA, 827 bp, Homo sapiens
  CDS (114)..(593)
ggactgtggcgaatgatgtatataactatctattcgatgatgaagataccccaccaaacccaaaaaaagagatctctcgaggatccgaattcgcggccgcgtcgacgagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatatttatattctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaataaaaaaaaaaaa

SEQ ID NO: 523 - DNA, 1612 bp, Homo sapiens
  CDS (248)..(994)
catttgtataccgtgacccagcctggctagcgtttaaacttaagcttggtaccgagctcggatccactagtccagtgtggtggaattcatctttgtatgatgtggctttaaattttttaaaagcaatgctgtctgtgaataacatggctaatttcttcgtagggtgatttctaacctagaagcaagaaatttggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacataaaaaaaaaaaa

SEQ ID NO: 524 - DNA, 955 bp, Homo sapiens
  CDS (3)..(866)
caatgtcgttgcacgcgtacgtaagcttggatcctctagagcggccgcgggcagacccggagggaacggaggaagcggtcatgtctcgctacacgaggccccccaacacctccctgttcatcaggaacgtcgcggacgccaccaggcctgaggacttgcgccgtgagtttggtcgatatggccctatagtagacgtttacattccacttgacttctacactcgccgcccaagaggatttgcttatgttcaatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaataggaggcggtcagacagccttaaagagtctcgacacaggcgattttcttatagccagtctaaatctcgttccaaatcattaccaaggcggtctacctcagcaaggcagtcaagaactccaagaaggaattttggctctagaggacggtcaaggtccaagtccttacaaaagaggtccaagtcaataggaaaatcacagtcaagttcacctcaaaagcagactagctcaggaacaaaatcaagatcacatggaagacattctgactcaatagcaagatccccgtgtaaatctcccaaagggtataccaattctgaaactaaagtacaaacagcaaagcattctcattttcggtcacattccagatctcgaagttatcgtcataaaaacagttggtgaacagcaacagaaagagcaccacgccgtctttaatataagttattaaactctcattatgttaaataaaaattctttaaggcatacagaaa

SEQ ID NO: 525 - DNA, 2593 bp, Homo sapiens
  CDS (263)..(1960)
aggtaccgctccggaattcccgggtcgacgatttcgtcacactggcacagacacaagcagggacacacgcagacacacgcacactcgcgcgcgcatcctcccgccagcctgcccgcctgctcgccggcgcccggagcccgctctggccgctggatgatctgaagctgccctctctccttcatttatatcaccagcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtagtggacatcctgaagaccacgtgccagctccgtcaggacaggggcggcatgatccagcactgcgagcagtaccagtttgtgcaccacgtcatgagcctctacgaaaagcagctgtcccaccagtccccagaatgactgcgcttctcctacaagggtctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggca

SEQ ID NO: 526 - DNA, 1733 bp, Homo sapiens
  CDS (215)..(1372)
cggccagtgcatagctaaaattaaccctcactaaagggaataagcttgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtgagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaa

SEQ ID NO: 527 - DNA, 731 bp, Homo sapiens
  CDS (109)..(639)
ctcactatagggaatttggccctcgagcaagaagttcggcacgaggcgcactctctaaggccccgggtgaagccccacctctgctgcgcgcacgctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttaaaaaaaaaaaa

SEQ ID NO: 528 - DNA, 1746 bp, Homo sapiens
  CDS (107)..(505)
attgttagggagacccaagcttgctagcgtttaaacttaagcttggtaccgagctcggatccactagtccagtgtggtggaattcaagcggcgagtaagatggaagatgaggaggtcgctgagagctgggaagaggcggcagacagcggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacaaaaaaaaaaaa

SEQ ID NO: 529 - DNA, 612 bp, Homo sapiens
  CDS (118)..(486)
catcgaaaggcttgatgtctataactatctattcgatgatgaagataccccaccaaacccaaaaaaagagatctctcgaggatccgaattcgcggccgcgtcgaccgcggccgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaaaaaaaaaaaa

SEQ ID NO: 530 - DNA, 4586 bp, Homo sapiens
  CDS (586)..(2556)
caggctccctcaggatgcactgttgccagtcagcgttactcattttattccctagggaacagtgggtttggtagaactctcttctaaatctctttttcatagaatttaaattataaattggtcatttactgttgtcacacaatattgcgttgctgaattttccactgattatattcattttatttcctcccagaacttggtttcttgtttttctgctcactgtccacacccactccaccccaaggctggaataattctcttggagcaaaaaaatcatctttttctttgtatttcattgaacgttctctttacagtgttaggtaaaccgctgctgcgcgttttgtcccgcgtctcgccccgtccgtctcctgactggccgctcttgtccttcctcccgctttttcttctctcgtcttgcggtctgaagatgccctcggccaccagccacagcgggagcggcagcaagtcgtccggaccgccaccgccgtcgggttctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaataagttcttgacttttctcatgggtggttgttggtacatcatattggaagggtaaaccctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctaaaaaaaaaaaa

SEQ ID NO: 531 - DNA, 2682 bp, Homo sapiens
  CDS (25)..(2286)
ccgaccagtttgtgtgacatttgtatgtgcagtatctctgtatttgaagaccctgtggatatgccctgtggacatgacttttgtagaggatgttgggagtcgtttttgaatctgaaaattcaagaaggggaagctcacaacattttttgccctgcatatgattgcttccaacttgtacctggggatatcataaaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaaatggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaa

SEQ ID NO: 532 - DNA, 1583 bp, Homo sapiens
  CDS (374)..(1558)
atgggaaattgtcctcaagcagctcgacaacttctgtgtgggaacccagaagcggttagaggttcagtgtactctcctggcaaaactgctggcgagtgtaccctttctgcagaaagtaaaaatggccttattcagacccccacagataccaacatccgccatgctcaagccccttacattatgtgggggtgcacggtgggtccttcccatccgcaggttcggcatccgtggatggggagtggatacagagggcggactatacagcttgaaaggcttccctggaagcaatatgtagagtggattgtggaggagcaagaacagaagcggggaggcttgtccagagcatacaggggaaggatcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggact

SEQ ID NO: 533 - DNA, 2734 bp, Homo sapiens
  CDS (116)..(1477)
  misc_feature (1)...(2734): n = a,t,c or g
aaggatccttaattaaattaatccccccccctccagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccactattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaatatatatatattgaaaatcaaaggaggcaaaattttgacagggaaggaagtaactgcaaaacactaggctttagtaggtacttatataaaatctagtccagttctcttcatttaaaaaaatgaagacacgaagtacagacttaaatagctcagatangcaattaggaaatttcaagttggccaataatagcattctctctgacatttaaaaataatttctattcaaaa

SEQ ID NO: 534 - DNA, 3024 bp, Homo sapiens
  CDS (1)..(1554)
atggcggaggctgcagctcccggaacaacagtcacaacatcgggagcaggagcagcagcggcggaggcggcggagacggcggaagcagtctccccgactccgatccccacagtcaccgccccgtccccgagggcgggcggaggggtcggcggcagcgacggcagcgacggtagtggcggcaggggcgacagtggcgcgtatgacggcagcggtgcgtgcggcggcagcgacgcgtgcgatggcagcggcgacagcagcggcgacagctggactaaacaggtcacttgtagatattttaagtatgggatttgtaaggaaggagataactgtcgctactcgcatgacctctctgaccgtctgtgtggtgtagtgtgcaagtattttcagcgagggtactgtatttatggagaccgctgcagatgtgaacatagcaagccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtagtagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctgggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaaaaa

SEQ ID NO: 535 - DNA, 1411 bp, Homo sapiens
  CDS (158)..(1333)
gcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcagctcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcatttgcacgtggaggagtgctaagcaatttgagagcaagatcataaagtcctgcccagaatgccagatcacatctaacttagtcattccaagtgagtactgggttgaggagaaagaagagaagcagaaactcgttcagaaatacaaagagtcaatgagcatcaaggcgtgcacgtattttgatgaaggacatgggagctgcccatttggagggaactgcttttacaagcatgcgtaaagaggaggagagaggagccacggagctaaaaccgctcgtgccgaattcttggcctcgagggccaaattccctatagtg

SEQ ID NO: 536 - DNA, 1755 bp, Homo sapiens
  CDS (55)..(942)
gcccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaaaaa

SEQ ID NO: 537 - DNA, 3716 bp, Homo sapiens
  CDS (87)..(3452)
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgaaaaaaaaaaaa

SEQ ID NO: 538 - DNA, 3811 bp, Homo sapiens
  CDS (87)..(3551)
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagtaagacccagaaaacatctttaattggttcttatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttaaaaaaaaaaaa

SEQ ID NO: 539 - DNA, 1865 bp, Homo sapiens
  CDS (218)..(1120)
atttccgggtcgacgatctcgtccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcaaaaaaaaaaaa

SEQ ID NO: 540 - DNA, 1736 bp, Homo sapiens
  CDS (218)..(991)
atttccgggtcgacgatctcgtccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcaaaaaaaaaaaa

SEQ ID NO: 541 - DNA, 563 bp, Homo sapiens
  CDS (185)..(460)
gcacgagctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagctgggggctcccaaaaccagcttacaatagccttttgcg

SEQ ID NO: 542 - DNA, 2100 bp, Homo sapiens
  CDS (33)..(1835)
gcacgagcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaaaaaaaaa

SEQ ID NO: 543 - DNA, 657 bp, Homo sapiens
  CDS (40)..(453)
ggccagtgaattgaatttaggtgacactatagaagagctatgacgtcgcatgcacgcgtacgtaagcttggatcctctagagcggccctactactactaaattcgcggccgcgtcgaccaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaaaa

SEQ ID NO: 544 - DNA, 1505 bp, Homo sapiens
  CDS (72)..(1208)
atttggccctcgaggccaagaattcggcacgagattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaacccttcttgttcaggactgtcatagccacagtttgcaaaagtgcagctattgattaatgcatgtagtgtcaattagatgtcaatcctgaggcttttatctgttgtgcttgccttttcctttcctt

SEQ ID NO: 545 - DNA, 1440 bp, Homo sapiens
  CDS (168)..(542)
atttggccctcgaggccaagaattcggcacgagggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaaa

SEQ ID NO: 546 - DNA, 1288 bp, Homo sapiens
  CDS (95)..(928)
accggcccggaattcccgggtcgacccacgcgtccgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcaggaactgagcctggggacgcccacccacacccactgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactaaa

SEQ ID NO: 547 - DNA, 2670 bp, Homo sapiens
  CDS (107)..(634)
gcacgagcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggaactgcaagcacatgttgaccagataactgaaatggcagcagtaatgaggaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaatacaatttcaaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaagtggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttttttttggttgttgttaaacagaaccttaagtttatgtttgaggtatgtactgcataggaacctattttattattaaagatgaatgattaaaattgg

SEQ ID NO: 548 - DNA, 1764 bp, Homo sapiens
  CDS (365)..(916)
atccgcttcgccggaacaatcctgtgagtttatgatatctgctatacagatgaggataacagaagttgactaacttgcccaagtcacaagtttgtaaagatggatctgggatttaaacccagtgagtgatggattggaactgagaccgaaatataatggaattttacattgcttgactaccatttggaaacttgatggactacggggactttatcaaggagtaaccccaaatatatggggtgcaggtttatcctggggactctactttttcttttacaatgccatcaagtcatataaaacagaaggaagagctgaacgtttagaggcaacagaataccttgtctcagctgctgaagctggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataagggatttgttcctgggctgtttggaacatcgcatggtgcccttcagtttatggcatatgaattgctgaagttgaagtacaaccagcatatcaatagattaccagaagcccagttgagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttctgctttttgccttccccatatatatggaacttggctacctctgcctgaaatggctgccatcaacacaatgttaaaactgacacgaagtatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatgggctcaatctcctgaccttgtgatccgcctgccttggcctcccaaagtgctgggattacaggcgtgagccactgcgcctggccagaccattttagaattgggaaattgtagtgagaaaaaatgcactgtaaatatgctttat

SEQ ID NO: 549 - DNA, 2482 bp, Homo sapiens
  CDS (50)..(2164)
aaggatccttaattaaattaatcccccccccccccccggggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctctccctgcagttcaactggtgtggggaggggctgctcacttcagcatcaccctcactggatagtggtcactgatggcttgggctgcaggcaagtgggcacagggtctggctgagcctacctgagctcctccctcgtgccgaactgttcgtcgagggccaaattccatatagtgcccgt

SEQ ID NO: 550 - DNA, 1187 bp, Homo sapiens
  CDS (64)..(759)
  misc_feature (1)...(1187): n = a,t,c or g
aatacaagctacttgttctttttgcaggatcccatcgattcgaattcggcacgagcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacagagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactanagagccctggagattggtggtagggaagggaggataacangaagtttgaaaaattagcagccccggggcctaaaggaatcagctgtcatcattttcatc

SEQ ID NO: 551 - DNA, 585 bp, Homo sapiens
  CDS (67)..(510)
tagaccacatagggaatttggccctcgaggcaagaattcggcacgaggctcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttctgtggtattcggcggagggaccaagctgaccgtcctaggtcagcccaaggctgccccctcggtcactctgttcccgcccctcctctgaggagcttcaagccaacaaggccacactggtgtgtctcataagtgacttctacccgggagccgtgacagtggcctg

SEQ ID NO: 552 - DNA, 3582 bp, Homo sapiens
  CDS (392)..(2647)
  misc_feature (1)...(3582): n = a,t,c or g
cgagactcaagaaaatcctgagatcagtacgaccgtgcgaaagtnccgtatcgacctacgcgtccggcaagacctcatctgctggtgtacctcatccttttagcccctctttgatgtttgctgcaaacgtcacccagctcctggggcacactggactcccagatgagcttgtcctggatttgcagggagcctggctccctaaaccttttggccagatccccacaggggaattgtgcaggtgcgccctccccagatccccagctggtattggaatcacaccaactgtcacacatggggagggcagctgcacccagccaccctctgacttctctcctgccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcgctttacaccagaggacacactcagaggagaagccttatggatgtcgggagtgtgggcgtaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttatacatttcctagtcagtggtattttattataacagctcaaatagactaagtaactgctcccctcatcattctctcacagtcatatctggaaataaaatctctgtatatgcaaaaaaaaaaaa

SEQ ID NO: 553 - DNA, 548 bp, Homo sapiens
  CDS (268)..(426)
agcgtgagattctacgaagataataccccaccaaacccaaaaaaagagatctctcgaggatccgaattcgcggccgcgtcgacgggggttcgattctgctgactccagtggcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgagtattatgacctgaaggcctcaacatttatctggactggaaatgattcgagatttgtgtgatgggcaactggagggggcagaaattggctcaacagaaataacctttacaccagagaagatcaaaggtggaatcca

SEQ ID NO: 554 - DNA, 3845 bp, Homo sapiens
  CDS (408)..(2120)
ccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgcccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaccaaaaaatccctctaggtagtttaggggaaaaatgtcccttttattttggctttggttgggatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcatttctgtaaacgagtttttaccactgttctcagctttgaaatcaaattaatcctgacttaatcagtataatgtacaagaacagaacatttcttaggactcctagtactttactttgagtaacaaaaggtcagagaaaatgaaccacccttaaagacacaaccttgggtaacactgttatattctcctagacaaaaattcttcataaaaatgttcttccagttcggaaggataaaatcaaattcccactttctggggtggatgcccaaaaccttcacaactcaagtgttctccaagtgcaaatgtcaaaatgggaggaggaaagggtttaaaaattagagaaaactgtatgcacttacggacttaaaaatccgaaaaacatagtaaaaagacaaaaaaacatagcattatgctctgaaatcacaaccaaagccaaaataaaagggacatttttcacctaaactacctagagggattttttgtttagttttttctttttcttttttttttcattttccagttaagtcctatgtcttttgtgaaattccaatacttaaactgcaagtctgcaatcgtctctgaagtcagtgaaattaagaaaaaagtcctaattctcttgaaggtcattttttcctcttaggatatgcagatgcaaccgttgctgcagtctgtgtagaactgccttttatttcccacgaccttgacgttcctacagaggtaagaaaaaaattgaaatggttaaaaattatctgaacatgctttatgaatttaaaaacttcacagaataactcaacagaaatttaattatttagaattattagaaaattaattattttaagtagaacattccccacaaagaaaaactggcttttactttgttttaaacacttaaacaccttaatgcaaaattacttttgacttgaaaattcattacatgctttcctattatactgtttagattaatacttagttgtcaggccccccaaaaatatgggcctaatggaagtaaccc

SEQ ID NO: 555 - DNA, 4352 bp, Homo sapiens
  CDS (77)..(1978)
gaaccgctccggaatttccgggtcgacgatttcgtgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagaggttcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagcctgatgggaaatgtgtggtgtcaagaccagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttctaaaaaaaaaaaaaaaa

SEQ ID NO: 556 - DNA, 1731 bp, Homo sapiens
  CDS (188)..(1108)
ttgaacccatcgacgcctgcaggtaccggtccggaattcccgggtcgacccacgcgtccgctgggctggaccgaaaccggcgcggagcaactgaggcccgagccttctcgggacccgggggacgcctaaccccgcgagaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgcaaaaaaaaaaaaa

SEQ ID NO: 557 - DNA, 1716 bp, Homo sapiens
  CDS (259)..(1377)
aaggatccttattaaattaatccccccccccccccccccccccgagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaaaaaaaaaaaaaa

SEQ ID NO: 558 - DNA, 918 bp, Homo sapiens
  CDS (187)..(846)
atttggccctcgaggccaagaattcggcacgaggactaacacacctctaacatttcacctctagctcagatgagagagagaatgggacttcttggtactgattgtttttcccatgcctcaattggtttcttttagggagctacaaatttacgggttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagagacccttccagaagagcagctcacgtcctgtggggccagtgactgcctgatggccaccacaaccaccaacagcacccagaggccctcccagcagctggtctacaccctcctgggcatctacactggtacgagctccatcggcccagggcagggtccctagcaaagcagagccaagcctccttcctgggctgacaaagactgtctctcccaatgtaaaaagtaatctctcttc

SEQ ID NO: 559 - DNA, 2511 bp, Homo sapiens
  CDS (47)..(2233)
accggaccggaattcccgggtcgacgatttcgttgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaaaaaaaaaaa

SEQ ID NO: 560 - DNA, 4478 bp, Homo sapiens
  CDS (339)..(3050)
atttggccctcgaggcaagaattcggcacgaggattttataataccggagttttgctctatcactgtatcatggacagcaagcttatggaacttattcctcaaaaagtgggacatgctgaaaatacaaacctagcttgagtttagttatgtccctaaatgttaactgatccctgtggtcagtagggagacagctggcatccgtttccaaccagccaaggatattcggtcgactgtactgactgaccactttgctcaggccgcaagtgtccctcagaaaagcctgaggacttattaaggtcatggaaggttgccttggcaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacttttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatggaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctacctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaa

SEQ ID NO: 561 - DNA, 1537 bp, Homo sapiens
  CDS (82)..(1392)
  misc_feature (1)...(1537): n = a,t,c or g
agcgggtnnncctganaccttgcagcaccggtccggaattcccgggtcgacccacgcgtccgcccacgcgtccgagaagatatggatcacaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcaaaaaaaaaaaa

SEQ ID NO: 562 - DNA, 1168 bp, Homo sapiens
  CDS (148)..(615)
tcggtaccggcccggaattcccgggtcgacccacgcgtccgggaaaaaagagaccatagacttccatcctggcctagagcggcccttaaagtgccagggagaggagggcgggtggggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtgttttatggtatgtgtccataatttaaaattcatgttatagtttcagtattaaggctgactttttttttttaagatatgtttgcaataagttaaaaaactgtaatacccttttgtggaaagctttagaaatgatataattattaaagatattaaacagacaaaaaaaaaaaa

SEQ ID NO: 563 - DNA, 3027 bp, Homo sapiens
  CDS (14)..(787)
gcccgcccaattgatggcgacccatggtggctcgcgtttaaacttaagcttggtaccgagctcggatccactagtccagtgtggtggaattcacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagca

SEQ ID NO: 564 - DNA, 1200 bp, Homo sapiens
  CDS (559)..(957)
actgaattgaatttaggtgacactatagaagagctatgacgtcgcatgcacgcgtacgtaagcttggatcctctagagcggccgcctactactactaaattcgcggccgcgtcgactttttttttttttttttttgaatgtgagccaaagatttatttcttcatttcttgcatttgaaatactcttcaatgacatccttggcctgagactccttgccatagtccttaactactacacaactgcaaccaaccactttacggggtttcccctctctgtcaattttacaaaggcctacccattctcctagtttcttgttgtcatcaaccttaattaggttgatttggtgttcagcacaaagggcctccaccaacttgacatacataggctcatcacagttggatgcaagcacacaaagatgggcttggcgcttgtctaaggctttggcagcttcgcgaattccacgtgctaggccatcgtggatgagggcagtcttcagaacctcttgtaaagcagtattaacgtccattacacctccagcagcaatgccttcctcggccatggcggtgggttacgggtgaagctgaatcttgaacgcacccaagcctccgcctccgcgcgactcggcggcattactagtgattactagtgaattcactagtaatattactagtgaatcactagtaatattactagtgaattcactagtaatgtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaa

SEQ ID NO: 565 - DNA, 5078 bp, Homo sapiens
  CDS (83)..(4666)
ggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaaaa

SEQ ID NO: 566 - DNA, 2416 bp, Homo sapiens
  CDS (286)..(1752)
  misc_feature (1)...(2416): n = a,t,c or g
gctgtaccggtncggaattcccgggtcgacgatttcgtctcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctcaagattacagaaaataatgagaatgaaattttaaaaaaaaaaaa

SEQ ID NO: 567 - DNA, 2549 bp, Homo sapiens
  CDS (1)..(1386)
atgccgtattcactaaacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaaaaaaaaaaa

SEQ ID NO: 568 - DNA, 2321 bp, Homo sapiens
  CDS (304)..(1992)
cgacccacgcgtccgcgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaaaaaaaaaa

SEQ ID NO: 569 - DNA, 1279 bp, Homo sapiens
  CDS (103)..(1092)
ccggtccggaattcccgggtcgacgatttcgtcgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggaagaggaagaagcccaagccaaggctgataaaattaagctggcgctggaaaaactgaaggaggccaaggttaagaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaggagaaatatgctgtatttaaaaacccccagaatttctacttggataacagaggaaaaaaagaaagcaaggaaactaatgagaaaatgaatgctaagaacaaggaatccttacttgaggtaaggttaattttgcagagtggaagaaaagagaaggacgtttgctctatttttaagtcatttgcttccgagaacaatggaaaaatctaaagacatacactgaaattttaagttggggtgttaaaatcaaattatttctaaattatagctatttagataattcaactgtttttcttttttgagtcatttgttacaacatgtggctttagataaatgaagctggatttgtaattcttgacttttaaaaaactctagcattccaagtttccattactta

SEQ ID NO: 570 - DNA, 1546 bp, Homo sapiens
  CDS (251)..(940)
tccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggaagggaagtgaagccgggggagggccggggagagcccaccacgcccacccctcccctctcccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgtttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataaaaaaaaaaaa

SEQ ID NO: 571 - DNA, 3470 bp, Homo sapiens
  CDS (1)..(1650)
atggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaagaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaaccgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagattttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaagtcgagcggccgcgaagcgagtagtagtaggcggccgctctagaggatccaagcttacgtacgcgtgcatgcgacgtcatagctc

SEQ ID NO: 572 - DNA, 2728 bp, Homo sapiens
  CDS (202)..(1212)
  misc_feature (1)...(2728): n = a,t,c or g
tcgaccccagcatcgaacgcctgcaggtaccggtccggaattcccgggtcgacccacgcgtccgttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtgttcccagccactcgggaggctgaggcaggagaatcgctggaacctgggatgtggaggttgcagtgagccaagattgcaccactgtactccagcctgggcaacagagggagactccatctagactccatctcanannanaaaaaaaaaaaaa

SEQ ID NO: 573 - DNA, 1270 bp, Homo sapiens
  CDS (334)..(906)
gcacgagagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctggatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaactaaaaaaaaaaaa

SEQ ID NO: 574 - DNA, 2842 bp, Homo sapiens
  CDS (345)..(1571)
  misc_feature (1)...(2842): n = a,t,c or g
attggaacngcccttggaanngcnctggaannnccgggncgacccacgcgtgcgccttggcagagtctggggtccctggactgagccatcagctgggtcactgagacccatggcaaggaaacaaaataggaattccaaggaactgggcctagttcccctcacagatgacaccagccacgccaggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcacacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaacattgcaactgtgttagcattattcacaactgaatctcccaaacccttctggaagctgcaaggaatcactctatgtttcagtagacccagcgttcttctatataggtagatgacctgccttcttcatgactcaacccatgatttcaaaatgaaattggggaaatagtaggttaatgctttatcaaagaaaaatcaatttggtctgataggggactcaacggattagagatcacagactgaggttctagtcccagctttaccacaagcagccttgacctgccctcaacctgggtcccagtgcctcaatgaccctaggcttccatccctgatataggctttcagaagtcagtggaaagattattcatagtgcctaagaaatgcctgtttccaatatttgaccttgtggatctcaggctttggagagcctaataccaacacaccagcctgcagattttgtctttcccaaactgtgttccaggaatgggctcaaaacttcagggctgacgctgtcctcaccccagactattagagtcctgtgtgctcacagagaacatgaagaagagcaatgtgtagaagacttaactttctcataactgcagcagggactgaaaattgacctccatccaaatgaaaaataatgttgaggatgattctaaagctaaacctaggcttgggtgggaaaaaanaaaaaaatttgtggattaattgggtggatcctctggcccacaagttgtgggggctcagagtgtcagcacatgtacctcatgtttaccaagtctagaagagatttctctgaaaaggtaatgagctgtcttgaaaaatggggagttcaccatcactcaaagtgctcaagggaagactgggtgattactcatcttgactgttgctaagaaaatctgtgtcaactttggaggaaggtgtttggaatagatatgttgaggggctcttctaactcttacatgctaaagttgtttgagtaagatctacttacagcctgccatcgtaatgtgtggcttgtggtttgggcgatttcctatacttgcttctaaaatgaaacaacgtgtcctaaagtaaagtaaagtgcacttgaattagcaa

SEQ ID NO: 575 - DNA, 3475 bp, Homo sapiens
  CDS (293)..(1996)
  misc_feature (1)...(3475): n = a,t,c or g
aaacgcagattcctcatcgcattctcagagattctgttggttagtattgggatggggccttttttcccccatgattctacgcggccacgtgttggtaaccaatatacagatgactgggtccttcccagtcccacgcgtttactcgatgaaggcagcctcccaccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattcctgaattccaccacactggactagtggatccgagctcggtaccaagcttaagtttaaacgctagccagcttgggtctcgcaaccaaaannnggggnttcaa

SEQ ID NO: 576 - DNA, 3319 bp, Homo sapiens
  CDS (293)..(1840)
  misc_feature (1)...(3319): n = a,t,c or g
aaacgcagattcctcatcgcattctcagagattctgttggttagtattgggatggggccttttttcccccatgattctacgcggccacgtgttggtaaccaatatacagatgactgggtccttcccagtcccacgcgtttactcgatgaaggcagcctcccaccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggccttggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattcctgaattccaccacactggactagtggatccgagctcggtaccaagcttaagtttaaacgctagccagcttgggtctcgcaaccaaaannnggggnttcaa

SEQ ID NO: 577 - DNA, 2124 bp, Homo sapiens
  CDS (261)..(1319)
cggtaccggtccggaattcccgggtcgacgatttcgtgtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttccttcactccgtgacctggagagttttccattttttgcaagtttagtactgcccaaatttactcattctacagtgttactgcactttgaacgtattgacccatgtcacccaagagaagcaaacatatggatgcactagagacaactcgggttgctgctctcagttaagggctatgagttcttggggtctaagtatctgtaaaattatcctctccatcagctctcactgatcattaatgtttctggatatttcttaccctaagatttgcttaccaacaaatcaaagaaacgcttcactaattatttttaaattgagaaaatagtattcagaggcaaagatttttatattcttttttgagaccaagtctcactctagcctgggcaatgagagtgaaaatcttatctca

SEQ ID NO: 578 - DNA, 1372 bp, Homo sapiens
  CDS (105)..(998)
taagcttgcggccgcggggtccggaactgcttgttccggcagtggaagagacgcgccggcgttggccgctgctgctagcacgttgaaccccagggtcgggaccgatgtcggcttgggctgctgccagcctaagcagggccgctgccgaatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaaaaaaaaaaa

SEQ ID NO: 579 - DNA, 2224 bp, Homo sapiens
  CDS (121)..(1953)
  misc_feature (1)...(2224): n = a,t,c or g
agggacggnaatttgacgccgtngatcgatcgcggtttcccgggtcgacccacgcgtgcggccgactgtgtggcagctgaggaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttggaaaaaaaaaaaaaagggggggccgttttaaaggatccttgggggggcccaagtttacccgggcatgcaacgtaatagttctttccctatagggagccgaattat

SEQ ID NO: 580 - DNA, 2083 bp, Homo sapiens
  CDS (121)..(1812)
  misc_feature (1)...(2083): n = a,t,c or g
agggacggnaatttgacgccgtngatcgatcgcggtttcccgggtcgacccacgcgtgcggccgactgtgtggcagctgaggaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttggaaaaaaaaaaaaaagggggggccgttttaaaggatccttgggggggcccaagtttacccgggcatgcaacgtaatagttctttccctatagggagccgaattat

SEQ ID NO: 581 - DNA, 1654 bp, Homo sapiens
  CDS (496)..(1302)
gcacgaggtgacattagcatcgggcagacccgccggacgaaggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtggtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttataaaaaaaaaaaa

SEQ ID NO: 582 - DNA, 2265 bp, Homo sapiens
  CDS (136)..(1779)
tcttttacatcaagctacttcgttctttttgcaggatcccatcgattcgaattccgttgctgtcgcctactggtactttgtatttaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccgagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataaaaaaaaaaaa

SEQ ID NO: 583 - DNA, 2091 bp, Homo sapiens
  CDS (167)..(1606)
tgtcctctctccattgaagattgaacgcctgcggtaccggtccggaattcccgggtcgacccacgcgtccgctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaagtttcatcttttaatttggccagtgtttccttcatgctaatctagatgctgtggctgattacttgcccaggatctcctgtggcagcctctgcttgttctctggcttggagtggatggggcagcctccagctcctgtggaagtaatggaatagtggtggaaagggaacacagagagggaggcttccagtaagataggtgtgtaagcccagccatcatgtttggaatggcatgaggcagca

SEQ ID NO: 584 - DNA, 826 bp, Homo sapiens
  CDS (225)..(614)
tggaggaacgggtcgagccacgcgtccggcgtttcgcccaccatcttctggggacagggtggagtccatatccgggacgggggggaggtggcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgaaaaaaaaaaaagtcgaccggccgcgaatttagtagtagtaggcggccgctctagaggatccaagcttacgtacgcgtgcatgcgacgtcatagctcttctatagtgtcacctaaattcaattca

SEQ ID NO: 585 - DNA, 907 bp, Homo sapiens
  CDS (225)..(695)
tggaggaacgggtcgagccacgcgtccggcgtttcgcccaccatcttctggggacagggtggagtccatatccgggacgggggggaggtggcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggtgagggactgggatttgtggggcgaggagggacctgtactagccatggttctgatcacatatgtcccatccctccatcaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgaaaaaaaaaaaagtcgaccggccgcgaatttagtagtagtaggcggccgctctagaggatccaagcttacgtacgcgtgcatgcgacgtcatagctcttctatagtgtcacctaaattcaattca

SEQ ID NO: 586 - DNA, 4272 bp, Homo sapiens
  CDS (309)..(1616)
acaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgcgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaaaaaaaaaaaa

SEQ ID NO: 587 - DNA, 1631 bp, Homo sapiens
  CDS (66)..(650)
  misc_feature (1)...(1631): n = a,t,c or g
tcggtaccggcccggagatccacgcgtgcgcccacgcgtccgcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggggcatcttttatgaccaagactgtccagtaccaaaatgagctacataaattcctaatctgggatacagctggacaagaacgatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttnacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcccctttttaaataagctctcatgatcaagatggtgatggtaaagaagctgcccggaataaactgaatttcatatgttctaaaatgcctagcaatggtttaaaaaggaaaaagagtggaagtgaaaaaggtggtataaatgctgtcaattttttttttaacccaagtattttggtggggaaaagcaagtatctattgcttagcatatgtaaagttgtagtctatatttatggggccattgcttaaagattataaattatgtaaatacattaataaattttaagtttcctttgcccttccaaaaaaaaaaaa

SEQ ID NO: 588 - DNA, 1503 bp, Homo sapiens
  CDS (575)..(1000)
cccccttgaacgcctgtggtaccggtccggaattcccgggtcgacccacgcgtccgggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattcaaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaaaaa

SEQ ID NO: 589 - DNA, 2045 bp, Homo sapiens
  CDS (102)..(1847)
accggtccggaattcccgggtcgacccacgcgtccgggcctgagtgccacagccagggcctctgctctgtacacagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaagcagctgacattcaacccggcccccaggtctgctggtcccccgtcccccacagccctcacagcattccccattgctcctggctcttcctctcccctaggtgggacagtgaaggggagcagtttaaccagaagattgctgctgcccttagggtctcagctccctcctctggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctta

SEQ ID NO: 590 - DNA, 5053 bp, Homo sapiens
  CDS (154)..(2409)
agggaattggacagcctggctgacttgccggagcggattaaaccaccatatgcaaacggactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatctcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttataaaaaaaaaaaa

SEQ ID NO: 591 - DNA, 2430 bp, Homo sapiens
  CDS (230)..(2008)
taccctgcggtaccggtccggaattcccgggtcgacccacgcgtccgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatttaataagctggtaccactcaggagaagtttattcttccagatgaccagcagtagacaaatggatactgagcagagtcttaggtaaaagtcttgggaaatatttgggcattggtctggccaagtctacaatgtcccaatatcaagggacaccaccctagctttcttagtgagacaatgtcagttatccatagatca

SEQ ID NO: 592 - DNA, 2394 bp, Homo sapiens
  CDS (230)..(1972)
taccctgcggtaccggtccggaattcccgggtcgacccacgcgtccgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatttaataagctggtaccactcaggagaagtttattcttccagatgaccagcagtagacaaatggatactgagcagagtcttaggtaaaagtcttgggaaatatttgggcattggtctggccaagtctacaatgtcccaatatcaagggacaccaccctagctttcttagtgagacaatgtcagttatccatagatca

SEQ ID NO: 593 - DNA, 1674 bp, Homo sapiens
  CDS (14)..(1297)
atatttcgagaggatgatgtatataactatctattcgatgatgaagataccccaccaaacccaaaaaaagagatctctcgaggatccgaattcgcggccgcgtcgacgcggggtcgagatggcggcgcctttgaggattcagagcgactgggcgcaagccctcaggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctcaatat

SEQ ID NO: 594 - DNA, 1577 bp, Homo sapiens
  CDS (97)..(570)
  misc_feature (1)...(1577): n = a,t,c or g
ttttggtataggcagacccaagctggctagcgttttaacttacgcttggtaccgagctcggatccactagtccagtgtggtggaattccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgacaggcacccaacctgatcttcctggcagtgagtccagaagagaaggaatcgtggatcaatgccctcaactctgccatcacccgagccaagaaccgtatcttggatgaggtcagggggctcactgtggggagagggaggaacgctggggcagagggaacagctgtgacccactgaagggggaggattgtgcaggccccgttttatccgctccttccaccagcgctacttctttnacccacccttttaaaagccctgatcttctttctaccttctctccaagtctcatctgacacctcctcttccccgcttcatgatgggggagccagccttgggtcagcttaaagagcccccttcgtgtccagtaaatccccttgcccattcagaagcagtgaatggagtgggcacatgttcaggcctcgggatgctgggttgggacagcgagtcgctgaagagcactcatgattcacagtacatctcttcaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctggaggaacccccaacccctgccctccccaacccgggggcagctgtcccggattcaggaccttggttagcaaggaaacttggaggagacttcaggagctttttggcagaaggtttcaagggactgggagatgggaagccgaaagggccaaggaccccctcggtcttcgccggattcccnggta

SEQ ID NO: 595 - DNA, 1745 bp, Homo sapiens
  CDS (76)..(1314)
ctgcctagcgtttaaacttaagcttggtaccgagctcggatccactagtccagtgtggtggaattcgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgtaaaaaaaaaaaaa

SEQ ID NO: 596 - DNA, 1963 bp, Homo sapiens
  CDS (84)..(1445)
  misc_feature (1)...(1963): n = a,t,c or g
tttggatacgccctcggtaccggcccggaattcccgggtcgacccacgcgtccgcccacgcgtccgctccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccgaggcaaggtctcactcggtcatccaggttggaatgcagtggtgtgatcacagttcactgtaaactcaaactcctgggctcaaggaatcttcctgcctcatccttccatcgtgcagggattacaggggagccttctgatggagcgtgatgccttgaagcccaactcgcccctgaccgagcggctcatccnaaggcagctaccgtccacctcatgcagtgagccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccagggggaatgtgtctactgcctgggtgggttcaaaggttgggaaggcagggcagaggtngggggctgatttctgctggggacaggtcttncagaggcagccttcccccattgcctgtcccctnccccaccagggttgcctttgggatnggacntttgt

SEQ ID NO: 597 - DNA, 2038 bp, Homo sapiens
  CDS (282)..(635)
cgtcacagcccgacgcgccacccagctgtttttgtgctcacaagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagcattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttgggtgccccttatctcaccccttccttgggaatttaataagtctcaggcatttccaattgtagactaaaaccactcttagcatctcctctagtattttccatgtatcaggacagaggtgtcttatggtaggggaggggggcaagtatgaagtaagggtaattatatactactctcattccaggattctttgctcccatgctgctgtccccttccaggctcacatgccacaggaatgctacatgatggccagctgccttccctccttggttatcatcccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaaaaaaaaaaaaaaaaaatttttatttaaccggccgcagcctaatcccttttagggggggtaaatttaagctgggccctggccgccgtttaacaacgccgggacgggaaaaacccg

SEQ ID NO: 598 - DNA, 2126 bp, Homo sapiens
  CDS (180)..(1688)
aaagtacctgtcgcacgacgaccggaccggaattcccgggtcgacgatttcgtcctacccccgtccctagtcccgtcagcatggtttggatcccctgtgccgtcgcctctttctttggcgacgcctccgccgccgcctgaggaggcgagctatccgggagttacaccgccaccgccaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggtaagaattctgactgctcactggccacctgtcccagtttgttttttccaaagggtcgcgccttctagtttgcaggagtggttcatgtgatccctacaggtccacaggttccctttttgtctccttatcattgtgtcctatttccatttgagcgagtattctgattaagaacatggtaaaatataatggctgaggttaacagaaagggacagaaagcttgggactcttggcttttccatagcactctattctcatcttcattttttcctaaaacaaataatagattttggtgggaggaatttatatttgtgctataaatctctttgaaacagttatttgcagtgcgtgtttgataagaaatgacgaaagaaagagtgaattatgaagtagcccagtgaagagtagtggttctagagtatgtgaacatctcatgtagcagttataggatgagaatatcttagagaaggaaaaatgtgttgggaaactcagatccttttcttcctatttcccactccacccatcagagtc

SEQ ID NO: 599 - DNA, 3679 bp, Homo sapiens
  CDS (176)..(2176)
cttgaaactatatggagaccctagctggctagcgtttaaacttaagcttggtaccgagctcggatccactagtccagtgtggtggaattccgctccttttctccccttctagagtgttacggtgactcttgggtccgaaggggacggacgtcctcccacgtaccatttagaagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaatgaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatattattctcatttgtgggagctaaaaattacaaataatcaaacttaaggagatagagagtagaatgatggttaccagaggctgggaggcattgaagggatggggagggaagtgg

SEQ ID NO: 600 - DNA, 1941 bp, Homo sapiens
  CDS (172)..(1143)
agattccgggattggaatcaaaatgctaatttaaaaggtcaagtgaagctgctcctcacgttttggcgtgccttgcctctctctgcaggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaaaaaaaaaaaa

SEQ ID NO: 601 - DNA, 790 bp, Homo sapiens
  CDS (49)..(648)
atttggccctcgaggccaagaattcggcacgagggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaaaaaaaaaaa

SEQ ID NO: 602 - DNA, 1006 bp, Homo sapiens
  CDS (365)..(835)
gtaccggtccggaattcccgggtcgacccacgcgtccgttccctgctccaagtcttctgggcgctccaggttctgtgatgtcccacgggagccccggacccctggtctctgtaactgtggggtgagggaaggtgcgacctgaatgttctccctgacctcctagtttcctagtcttgcacgttctattcttcccagggtcacattcaccacacccacccactcctgtcattcccttccctttcaccccttctgtctcatttagctccactttgaaaaaactgtggcatcaaaggtccctgggtagtcccttcccaaatggtccgctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggccttaatagggatgagaggaaagaatattattgaaattatatacattgattcacttattcagtgtagagcctgtattctgaagaagtttgacaaaacgtt

SEQ ID NO: 603 - DNA, 1752 bp, Homo sapiens
  CDS (104)..(1195)
catcgactcactatagggaatttggccctcgaggcaagaattcggcacgagggtagggaaactgtgagggcggcaccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcaagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctcaaaaaaaaaaaa

SEQ ID NO: 604 - DNA, 1013 bp, Homo sapiens
  CDS (89)..(565)
ccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagttcccttgcgtgtccagcccctccagacaccaccacttcagaaactct

SEQ ID NO: 605 - DNA, 1199 bp, Homo sapiens
  CDS (410)..(1072)
ccggtctctgttgccatggcaacacaggtttatttacaccataccctggatgcaaggtggggcagggttgcggggagggagagggagtacagtgatgtcaagagcacagggctcctggccttcagaccagtcctcagctacattgctgcaggcaaggccggcaccagcccccaggctgagtcatgggtaaaggccaagagctgaaacaagagtttctcatgcaccaggcacatttataaagcaacccatccacctggagcccaaaactgggttgacagattccagagaggcaaggtccttgatgaccccataactcccactgcccctttaacaagggactcttaacaccttatgataacccaaatcctaaacactgttgcctctgccgcctcttccagacacagaaggcatgatcctgctgaacactggcctcgagggaactgtggctgaaaaccccgtgcccattgttcatactccaagtggcaacatcctgacgctggagtcctgcctgcagcagctggccacacatcccggacactggggcatccatttgcaaatagcggagcccgcagccctccggccatccctggccttgctggcacgcctctccagccttggcctcttgcattggcctgtgtgggttggggccaaaatctcccacgggagtttttcggtccccggccatgtggctggcagagagctgcttacagctgtggctgaggtcttcccccacgtgactgtggcaccaggctggcctgaggaggtgctgggcagtggctacagggaacagctgctcacagatatgctagagttgtgccaggggctctggcaacctgtgtccttccagatgcaggccatgctgctgggccacagcacagctggagccataggcaggctgctggcatcctccccccgggccaccgtcacagtggagcacaacccagctgggggcgactatgcctctgtgaggacagcattgctggcagctagggctgtggacaggacccgagtctactacaggctaccccagggctaccacaaggacttgctggctcatgttggtagaaactgagcacccaggggtggtgggtcagcggacctcagggcggaggcttcccacggggaggcaggaagaaataaaggtcgaattccaccacactggactagtggatccgagctcggtaccaagcttaagtttg

SEQ ID NO: 606 - DNA, 4721 bp, Homo sapiens
  CDS (162)..(2018)
  misc_feature (1)...(4721): n = a,t,c or g
agtggcactgagctgaagcgtcgcgacnngcnnngaantnccgggtcgacccacgcgtccgcaactgtcaaggcatgtggaatacaccagcattcatattactacattctaacagagtgggggaaagagggaagacagaagataaataataaacatagtagatggcttttcgcactgaaatgggactatattattcctatttcaagactattgtggaagcaccctcatttttgaatggagtatggatgattatgaatgataaactgactgaatacccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagaaatgaaaaaaaaaaaa

SEQ ID NO: 607 - DNA, 2065 bp, Homo sapiens
  CDS (171)..(977)
ggaagaaaaagcacgtcattacttggagaccttcagagccaagctattaagtttgtaaataggtttcatgaagagagaaaaaccaagctcagcctcctcttagacaatgagcgctggaagcaagcagatgtctcctgcagaatttcaggatcttgttgattctctgtcagatgggaagattgctttacctgaaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacgaacaaagaccagggagaaacagaacttttaaaactataggctgctgtgttggggccagaaataaggtgacaagtaaagacttttataatacctaccttcaaaattagaatcagcagcactgtacaaataaagtgcctgtgctt

SEQ ID NO: 608 - DNA, 3806 bp, Homo sapiens
  CDS (193)..(1746)
aattgatcgcctgcggtaccggtccggaattcccgggtcgacgatttcgtccggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccgtggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctctagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaaaaaaaaaaa

SEQ ID NO: 609 - DNA, 2573 bp, Homo sapiens
  CDS (200)..(1840)
acccgtccggaattcccgggtcgacccacgcgtccgcggacgcgtggggtgagtttggtgtacaaaacaaatctttcttcagttggggagctagggtagcgcactacgggtcactcttgctttctttgcttcacaggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccataaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctgaaaaaaaaaaaaa

SEQ ID NO: 610 - DNA, 1654 bp, Homo sapiens
  CDS (200)..(1618)
acccgtccggaattcccgggtcgacccacgcgtccgcggacgcgtggggtgagtttggtgtacaaaacaaatctttcttcagttggggagctagggtagcgcactacgggtcactcttgctttctttgcttcacaggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccataaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaaggtgggccagaagtcaggactgtacagccaggccgctaaggttctagttgcccaggagggcatgaaagcggactggtgtgggaatttgacaagctccttattaaccaaggtttgtaagagttggagtttagggaaggggctcaagccagggaacatgaattccatctgtactcaccagtcctcaaggagcagggcagggctttccgtacaagaaaaatggaagaccggtcaggtacagcggctcacacctgtaatcctagcactttgggaggctgaggtgggaggatcacttgagctcaggcgttccagaccagcctgtgaaacctagcgagacctcatctctatttatttaaaaaaaaaaaaa

SEQ ID NO: 611 - DNA, 1000 bp, Homo sapiens
  CDS (163)..(942)
ccgttgcaccggtccggaattcccgggtcgacccacgcgtccggtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgcggaccacattctgcagcacctattgtgaagcaatgtgtgcatctgaagcaacttgaaatgcagcttcttattgtctgaatgaatcc

SEQ ID NO: 612 - DNA, 2276 bp, Homo sapiens
  CDS (355)..(1236)
ggggtgatttgatatgcaggaccgagtgtgttcttcccaacgcccccggaagaacgtctttgacgggcaggtgtgagagccagttggcgctccaggccaggcgacagcctcgggccccaggatcgtgcagcaggggtcggagcccgctgccgagggcagggcagggcaggtcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattactttacttactgtatttttatggcaggagggagaaaaagtgttacaacggtttctaatgaagtccggtatttaaatgataaatgactaatgtgtttagtagagacaaaagaaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataaaaaaaa

SEQ ID NO: 613 - DNA, 3127 bp, Homo sapiens
  CDS (71)..(3079)
accggtcggaattcccgggtcgacgatttcgttcgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctcttttacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaaaaaaaaa

SEQ ID NO: 614 - DNA, 1440 bp, Homo sapiens
  CDS (387)..(1187)
aagcttggcacgagggtgcagctgggctcagctccccgtgccctacctttctgttctcttccttggtttcccctactctcctcctgccccaagcagtgcctgatgccgagttccgtctctcgggtcttttcctggtcccaggcaaagcggagcggagatcctcaaacggcctagtgcttcgcgcttccggaggaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctaccacttttttatctcagaaaataaagtcaaaagactatg

SEQ ID NO: 615 - DNA, 1738 bp, Homo sapiens
  CDS (196)..(1467)
atttggccctcgaggccaagaattcggcacgagccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcccccttcataacagctaacgtatcactttttcttattttgtatttataataagataggttgtgtttataaaatacaaactgtggcatacattctctatacaaacttgaaattaaactgagttttacatttctctttaaaggtaaaaaaaaaaaa

SEQ ID NO: 616 - DNA, 3084 bp, Homo sapiens
  CDS (633)..(1883)
gcgagacgtcgcgcgggggccgcgctgccgcctctgccgggaccgctgccgcccgccaccgccagtgccactgatgctgaagggaccgccccgcgccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaataaaaaaaaaaaa

SEQ ID NO: 617 - DNA, 907 bp, Homo sapiens
  CDS (61)..(747)
atttggccctcgaggccaagaattcggcacgagggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaataaaaaaaaaaaa

SEQ ID NO: 618 - DNA, 961 bp, Homo sapiens
  CDS (61)..(801)
atttggccctcgaggccaagaattcggcacgagggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaataaaaaaaaaaaa

SEQ ID NO: 619 - DNA, 5531 bp, Homo sapiens
  CDS (108)..(1856)
agaccctggggaggtggctgctcggagtttatgagacggttgcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggtgaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctgaaacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatctaaaaaaaaaaaa

SEQ ID NO: 620 - DNA, 1534 bp, Homo sapiens
  CDS (43)..(1161)
atttggccctcgaggccaagaattcggcacgaggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacatttccacgacagacttaactgtataatttcgttgtaaaatctgtaagttgtaaatattgtacatagttaaatctgtattctgttttgaatttttttaattaatagaaagaccaaccggcaaactttcaaaaaaaaaaaaa

SEQ ID NO: 621 - DNA, 2315 bp, Homo sapiens
  CDS (257)..(937)
aaggatccttaattaaattaatcccccccccccggtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccatcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgacttttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagatgaccttgtgattttgtgctgattgtgtctgaggacctttccctccacatatggtctggcagatgcacccagttcagcctaaggagtaggcttttttttgggggggggaagatcgggtgggggggatttttaatcttttaattttcaagatggttaaaatattgaaatgtttaagtggataactatattattcataaaatgactgagtgaaaactaatacactatgagatgaaaagtaaaaaaaaaaaa

SEQ ID NO: 622 - DNA, 2781 bp, Homo sapiens
  CDS (263)..(1750)
ccggaccggaattccggggtcgacccacgcgtccgcaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcctgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgattggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttgaaaaaaaaaaaa

SEQ ID NO: 623 - DNA, 5310 bp, Homo sapiens
  CDS (311)..(1606)
ggtgtgtgcgtcatcgatcgcctgcggtaccggtccggaattcccgggtcgacccacgcgtccgcccacgcgtccgcccacgcgtccggtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaaatctatatataacaatgtaaccatatacttgcatgtcttaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctcccccttaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggcaaaaaaaaaaaa

SEQ ID NO: 624 - DNA, 2812 bp, Homo sapiens
  CDS (119)..(2200)
gtcgacgatttcgtcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaaaaaaaa

SEQ ID NO: 625 - DNA, 1878 bp, Homo sapiens
  CDS (945)..(1229)
attgaacgcctgcggtaccggtccggaattcccgggtcgacccacgcgtccgcggacgcgtgggctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaaaaaaaaaa

SEQ ID NO: 626 - DNA, 1310 bp, Homo sapiens
  CDS (95)..(955)
tagtaccggtccggatttcccgggtcgacgatttcgtgctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctgaaaaaaaaaaaaaa

SEQ ID NO: 627 - DNA, 1477 bp, Homo sapiens
  CDS (352)..(1011)
cttggaccggctgcatcgagtgactgatgtatataactatctattcgatgatgaagataccccaccaaacccaaaaaaagagatctctcgaggatccgaattcgcggccgcgtcgacgcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaattggtgccattacttgtgattaaaaaatgcaattcacaaaatatagggactgtattgcggccgctctagaggatccaagcatacgtacgcgtcaagccacgg

SEQ ID NO: 628 - DNA, 2432 bp, Homo sapiens
  CDS (720)..(1454)
  misc_feature (1)...(2432): n = a,t,c or g
gcctgcgtgggcggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaanggcactctgtgagtagagaagtatcatttaagcttattttagtcacatgtagtatatatctccttaaagctgtcactctcactttcttaccattc

SEQ ID NO: 629 - DNA, 1883 bp, Homo sapiens
  CDS (317)..(586)
  misc_feature (1)...(1883): n = a,t,c or g
ggctggacggctcttgccaagctaaaatntaaccctcactaaagggaataagcttgcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataaaaaaaaaaaa

SEQ ID NO: 630 - DNA, 1150 bp, Homo sapiens
  CDS (717)..(863)
attcaaatattatcactatagggaatttggccctcgaggcaagaattcggcacgaggcgttccaggacgctgaggaccacctcctcccctaacgcacagcccaacgatcctaaaagtaaaaaccctgagtttctgagtcaagactgagctggtggggtggggaccgagtaggcgtggatggggagcccagcggtccccagcggagaaaatgggtgagacgcctggggccgcggtctccagaattcgcctgggagggagagtggcgctacggcgccatgtccatggggagccgcttcgggctccggagtgtccgctggggcccgacgcttgggtcccgacgcgcggttcgcactttccaggtttcttccccagggaacagagcttgagcggggggccacccccccgtcctaccggagttctgaggtgcggtcaggcgcggagagcggacgcccagcgccagattctgtgggctccggagttcaggcccactgagccgcagctgagcacaggcggggcaggaaaaaggatgaggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgttaaaaaaaaaaaaaa

SEQ ID NO: 631 - DNA, 712 bp, Homo sapiens
  CDS (193)..(423)
ccatagggagacctcagctgcctagcgtttaaacttaagcttggtaccgagctcggatccactagtccagtgtggtggaattccttctggttaccactgttttgaagcttcattgtggctaatccccctgcagaacctcaaaccacttagagatcaactccatagatctttggttttcttcatctgtttcacatggaacacagctttctcctagtctgtgctttgtttgctcacgtgtttttttcttcctcttgtggttcatctgtggcactccattccgacccttgccttctgtcccctgtacttctgaactgtctccctggggacctccgccctctagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcctgccttctggtttgaacgtcagagccttcttctgatgtgtctgtgactctacaaccgaaataaagacgggcagtcctcctcttcatgccccctcattctcattttctccacttgctgcctttgagctgtagctgtgtgcccttaaccatagcctgaaacacaaagtgggtggttagcctctctcactcacaaatgaaaagcttattac

SEQ ID NO: 632 - DNA, 2610 bp, Homo sapiens
  CDS (338)..(2038)
tcccccaagctggctagcgtttaaacttaagcttggtaccgagctcggatccactagtccagtgtggtggaattcgtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatgggtgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgggcacgacgcttccacaagttgtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggttggcactgcacaccgtactaatttttgtattttttgtagagacgaggtcccaccatgttgcccaggctggtgtcaaactcctgggctcagtcagtccccccatctcacccttcccaagtgcttggattacaggcgtgattacttttgcccagccttacggacattccttttgattatctttttcattgataggatatgaattgattttg

SEQ ID NO: 633 - DNA, 2823 bp, Homo sapiens
  CDS (333)..(1526)
tttggttagctagacccacgctggctagcgtttaaacttaagcttggtaccgagctcggatccactagtccagtgtggtggaattccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctgacactctggccccatacagcagaaggcagggatctgctgggagctgagaacagagccttgactggtgggcaacaagcagaggatcccaccttggcctcaggggcttatcagtggcctggctctgttgagaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcgcccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccggaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctgcagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggaggtagtatggggttttcaatctcaaagcgtccctttctgccttctcggctctggctatttattcccttgcaccaacaaatacattcgaaaatgttctgtgagctgctcaagaaactgtaaaaatgtgtgatgcacgtgcatatgcagagtgggagaactttgtgtgtgtgtagaggtgtgtaggtgtgggtggcatgtgtgcacgcctgcatgcaatacctgagaccaacctaataaaggtacaatcttcatagaactgcacttgcagcctggagttgctctggctgaaagtagactcaggcttaagaaatgaaacataatgcgtttgtctttatagactttaaattttcaattattactcagttatgtttttggtttaaaaaattataaaagtctaaaagtaatacatgctcagtaaaaacaagtccataaaaaatagaagcatatgacaaaaagcataagtcccacaaactccctagcggtgtgtatgtgtgtgtgtgttattcatggtcacactacatgcaaattaaaaaatgaaagtgtggtcatgctttgtcaactcactatatttttactttattaactatattctgtatcagccatctgaattgacccaatctttattggtgactgcatgaaattccaaggcagggatgtgtcatattttctttagctggtcccataatcatgaacatttaagtagctccaatttttcatcaattacagacattgccgccatgaacatgattgcatggcgtgcaagtatttctgcgaggtagatttccgtacgggatttctggggcaaagggtatgggcattcagtattctgagagaaactgccaaattgctctctgaaatggtggtgtcaatttacatttctcccaagagggtaggagactgattatttttctacaccttcaccaacacttggcattctcagacttttggtttttttttggcctatttaggaggaaaaccgattttaaaagctgcatttccttaatcatgaatgaagtcatctttccacttatttgccagacatttgtattttcttttctgcattgtctttttgttttaagatgtttgccctttgcttgttaatttgttggaaatctttgactctaataagtgtgatcaatcttttctctgctg

SEQ ID NO: 634 - DNA, 659 bp, Homo sapiens
  CDS (225)..(560)
gtgtggacattgttggctgatcatataactatctattcgatgatgaagataccccaccaaacccaaaaaaagagatctctcgaggatccgaattcgcggccgcgtcgaccttttcccacgtggtgaatgccctggagttgtgagggtgtgagggtcgcgttcctgctgtctggactttttctgtcccactgagacgcagctgtattctgtttgcagtgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaaaaaaaaaaa

SEQ ID NO: 635 - DNA, 2141 bp, Homo sapiens
  CDS (3)..(1922)
ccatgaacctgaaacgtcgcaccgacgaccggaccggaattcccgggtcgacccacgcgtccgcggacgcgtgggcgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcaaaaaaaaaaaaaaaa

SEQ ID NO: 636 - DNA, 1841 bp, Homo sapiens
  CDS (304)..(1809)
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacttaggggcccccgcctccaacaacaatgctgctgatgccacccccagcggcagcctggccagagccggggaggctgggaagctggaggaggtgatgcaggagctgcgggccctgagggcgctgtggaggatgtatacgcccaggcgagctcctcgacctgtgagggaccatctccccgaccactgcccagacctctgctccctccccagaggaggcgggagggtgggctaaatattttcattccaaataaaattctctttcta

SEQ ID NO: 637 - DNA, 1763 bp, Homo sapiens
  CDS (66)..(1127)
atttggccctcgaggccaagaattcggcacgagtgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccaaaaaaaaaaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttaaaaaaaaaaaaaaaaa

SEQ ID NO: 638 - DNA, 1601 bp, Homo sapiens
  CDS (256)..(564)
gcacgagggagtgccagtacagatgaaagcaccccaatccgtctcctccagttctttaggtttaatcacatctctccaatcgccgagggaactggagatttaaacaaacatacgtgaactggtgtgaagctgtaaaagggaccattatgtttccgattcagaatatatattcttctctcactttctaagaattaaacacaagcttttctcccttattgattagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaatgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtttaaaaaaaaaaaaa

SEQ ID NO: 639 - DNA, 927 bp, Homo sapiens
  CDS (91)..(903)
ccggtccggaattcccgggtcgacccacgcgtccgatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgttgattccttgcattccaaaaattcaatctatgattgaagatgcatggaaggaaggttttgatcctcagggggcctctcaacttattatcaggttacagggaacaaaggcctggattggagcatgtgaagtatatatactcctgacctctctaagggtttagtgtcttattgttggattttcactg

SEQ ID NO: 640 - DNA, 829 bp, Homo sapiens
  CDS (120)..(428)
ccggtcgacgatttcgtctgtgaggggccgcgtctcgcagcagccgcccggaccgggcatggtttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtacattttcctgatccaaacaagcttcattgttttcagctaacagtaaccccagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgaaaaaaaaaaaa

SEQ ID NO: 641 - DNA, 2052 bp, Homo sapiens
  CDS (265)..(1422)
gcacgaggagcccccagttccgtagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggggggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaataaaaaaaaaaaa

SEQ ID NO: 642 - DNA, 2681 bp, Homo sapiens
  CDS (215)..(2083)
taagcttgcgtccgggctccggtctcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaagccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaa

SEQ ID NO: 643 - DNA, 2579 bp, Homo sapiens
  CDS (215)..(1981)
taagcttgcgtccgggctccggtctcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaagccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaa

SEQ ID NO: 644 - DNA, 1540 bp, Homo sapiens
  CDS (186)..(1406)
tgggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttaaaaaaaaaaaa

SEQ ID NO: 645 - DNA, 1753 bp, Homo sapiens
  CDS (284)..(967)
  misc_feature (1)...(1753): n = a,t,c or g
ccacctgttgccatagcatccgggtcgggtgaaccaatccgggcgccctcgcgaacagaggcgggcagttcgcatcgccgaccaacctgaggcgtttttgttgtggcgcgtgaccggagaggcgggantcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttttactggaataatgtttatgattacaagtgagataaggtatttttatcaatatgaaggcaaccttggctgataaaacctctatagtgaatactcccatctttacttccctccctatcaataataaatatattttttgccaaagactggcaaaaaaaaaaaa

SEQ ID NO: 646 - DNA, 1069 bp, Homo sapiens
  CDS (156)..(839)
gcggccgctccaacatgttaccattctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggacacagcaggccaggaaagatacaggactatcaccacagcctattatcgtggagccatgggctttattttaatgtatgacattacaaatgaagaatccttcaatgcagtacaagattggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgcaaa

SEQ ID NO: 647 - DNA, 1886 bp, Homo sapiens
  CDS (202)..(1152)
  misc_feature (1)...(1886): n = a,t,c or g
gtcgcggaanccccaatgatacctgatggaaccgcctccggaattcccgggtcgacccacgcgtccgaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgctggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtggccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactttggggctggagttctttgttggggatgatggatgtggaatgggcatgactgtatggccattttggcactagagtcccctggggatgctgtgctggccatccctggcccctgggcaggttcaggtaggctgggagctgaaacatcagtttgggggctgcactgggccctcactgggtgaagtctgaatggctggctttgagagccctttcccctgatcctttccccacacgtgtcctcctacttggtgcttatacccaaattttcaccactggagaatctttttctttttttcacccttttcttgccttccctttaagaagtacttttccaggcagggtgcggtggctcgtgcctgtaatctcagcactttg

SEQ ID NO: 648 - DNA, 1905 bp, Homo sapiens
  CDS (98)..(718)
gtccggaattcccgggtcgacccacgcgtccggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaaaaaaaaaaaa

SEQ ID NO: 649 - DNA, 2905 bp, Homo sapiens
  CDS (120)..(1112)
gcgccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcaggatgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaaaataagttagaagcttattcttggtttgtgtaatgaatttatgtattgtagtgaatacctttactggtgtgaagataattatgcacaaaccctcacaatacgcgttaacattgaaacctgtgaaatgtccttaggttgggtcatataaagccaaccatttttgaggaccatgtacctagtgctttgaaaactgtaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggacatgggcaaacatgctgattggtgcaaatgtggtgccgagctgtccatagctgcagtgaaagatgaagagcaagaccttctctaggttttctagctttcattaaatgtatttttttccccagaaaaaaaaaaaa

SEQ ID NO: 650 - DNA, 1724 bp, Homo sapiens
  CDS (336)..(1388)
ggtaccggtccggaattcccgggtcgacccacgcgtccggttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataaaaaaaaaaaa

SEQ ID NO: 651 - DNA, 2464 bp, Homo sapiens
  CDS (55)..(1602)
cttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcatactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaaaaaaagatgatacatgtttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaaaaaaaaaaa

SEQ ID NO: 652 - DNA, 907 bp, Homo sapiens
  CDS (205)..(597)
  misc_feature (1)...(907): n = a,t,c or g
ttcgacgactactagtccagtgcggtggaattcccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccgccctgcctgtgtctggggcctgggggcttctcccctcgctgctgcaccctggcttncaacggctgtgtcctggccttacgtgccccttccc

SEQ ID NO: 653 - DNA, 3446 bp, Homo sapiens
  CDS (1)..(2136)
atgacagagatttcttacggaaaatccaatggagcggataggaggggccgggtcggccgaagcccgaaccgaaggagcgggcatgaggcgctgcccgtgccgtgggagcctgaacgaggcggaggccggggcgctgcccgcggcggcccgcatgggactggaggcgccgcgaggagggcggcggcggcagccgggacagcagcgacctgggcccggcgcaggggccccggcggggcggccggaggggggcgggaccactgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgctgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaaaaaaaaaaaa

SEQ ID NO: 654 - DNA, 2672 bp, Homo sapiens
  CDS (223)..(990)
atttggccctcgaggccaagaattcggcacgagtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggaagttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttggggaggcggaggcggaggcgggtgggtcacttgaggccaggcgttccacaccagccaggccaacatagctcactatctagtaaaagtacaaaaattagccgggggtggcggtagaaatacactttagtagtgtatcagtattggttcagtggttgtgataattatataaagaatctacagcagaaaaacctggttttcagaaatacatctttgaagagaaagcaaaataatatcactattagctagagaaaattaagtacaacaaaaagacaaaataataggacgctcaggcctttagtcaagaaaacaaaactaattgttgagataatttaagaattttattcttttcagcaagaaatgagctggagaatagaattttcagtgaataaagttacacagttgtccctctgttcactcgggggtttggtgccaggatgcatatggaaccctcgcgcacacttggggtttacagtctctcaaacactgtggtactttctatctgcatttagtaagggggagaaaaaacaagtataaagtggaccagcgcagctactagtgttcaagggcaaccttagtttacctattataaaacaagtgacttaatatatttaataccacaaaataacatatttattgtgtaattctgagttctcttgggaaataactaccagattaatgagtattttaaaatctctctcttttttttttagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtatttacaaaaaatacaaaaattagccaggcatggtggtgcatgcctgtagtcccagctgtttgggaggctgaggcaggaggatctctgagcccaggatgctaaggttgcagtgagccaagatggcaccattgcactccagcctgggcagcagagcgagaccccgtctcaaaaaatacatttattttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgcca

SEQ ID NO: 655 - DNA, 1666 bp, Homo sapiens
  CDS (367)..(717)
accggtccggaattcccgggtcgacccacgcgtccgctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttgaatggtgttttcatcttctttcatcttcaccctgtctcacgttacgttatttttatcctgatgacagaataggtactacaggtatttttactctggttttacagtcaaagaaactgaggcacaggcaggtttgcccaaggtcacataactgcttaatagcagggtagacaggtgaagtaactggatgtgtatcagccatgccctttccccatgcccccggcactccccatgacagctctctgaatcccaacaatttattcttttgcaggattagacccaagcatataaattcctttttccctctcaaaaaaaa

SEQ ID NO: 656 - DNA, 2021 bp, Homo sapiens
  CDS (335)..(1966)
cgccgcggtaccggtccggaattcccgggtcgacgatttcgtgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcaaaaaaaaaaaa

SEQ ID NO: 657 - DNA, 1098 bp, Homo sapiens
  CDS (119)..(826)
  misc_feature (1)...(1098): n = a,t,c or g
tagggcnnnnnttgatccctgagcacgtccgaaccggnccggaattcccgggtcgacccacgcgtccgcccacgcgtccgcggaagtgacaactgcagccgcacgtgggctcggcgcgatggaggaggagacgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcactttaacaaaaaaaaaaaa

SEQ ID NO: 658 - DNA, 3483 bp, Homo sapiens
  CDS (94)..(2064)
tttgatagccgttattcgagcacgtaccggaccggaattcccgggtcgacgatttcgtctgaggtggcagcagggggcgggacgcgcagcgctatggcagagggcagcggggaagtggtcacagtgtctgcgaccggggctgccaacggcctcaacaatggggcaggcgggacctcggcgacgaccagcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagttaaaaccactaagcttcaatctgaaagccaaaaattagagataagagctcaagttgcagatgccttcttatccaagttccaactgacttctgatgaaatgagtcttcttcgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggtattatcatgtgtcttggatcctctcctacagatgtgtgctgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaaaaaaaaaaa

SEQ ID NO: 659 - DNA, 1299 bp, Homo sapiens
  CDS (198)..(971)
accaggggccttccattagagtttaatgctttgctgcggtttcctgaaagagccccacagagagtgggtctcgatgggtcctgaaccgcaccacaaccggccagtgaggtgaggggcgaagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattca

SEQ ID NO: 660 - DNA, 1091 bp, Homo sapiens
  CDS (123)..(494)
tgcagcaggggcagcgcgtgcggacccggggccggcgcgcatgcgccagcgcgacgcccttggaggggtgcgtggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggccagttaaaaaaaaaa

SEQ ID NO: 661 - DNA, 1125 bp, Homo sapiens
  CDS (291)..(821)
ggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtgggtgcactgaggcgcacgacttccgtgacatccctccaatgatgcgcaactccctactcgtgagaaaacgtgagaccaacccaaacggggagacactctgcagagtgaccagcgcttcaaaagtgtcaagtttatgaaagacacacagattgaggggctgcaacagattggaggagacaaagaagacagtttagctaaatgcagtgtgagatcctggaacaaaaggccaggaatggaaaaactcgtgatgttcaaattagggtaatcatttagttaatggtagtgtatcgaagttaaccttctgggtttgatcattgaactatggagccgggcatggtggctcacgcctgtaatcccagcactttgggaggctgaggtgggtggatcacttgagcccaggagcttgtaaccagcctgggtaacacgacaaaaccccatctg

SEQ ID NO: 662 - DNA, 1467 bp, Homo sapiens
  CDS (192)..(1001)
gcacgaggacgccgagtgaggctgaggctgggggcgaatcgccgcagagctgcgtgtcggcggcgcattctgattggacagcggggaagcccgtcagcctgttggccccgctgatcccgccccgtagcgcagggcagcctttaacctttagccccagtgggcgccagccactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcgggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaaaaaaaa

SEQ ID NO: 663 - DNA, 1239 bp, Homo sapiens
  CDS (118)..(702)
gccttatgtatataactatctattcgatgatgaagataccccaccaaacccaaaaaaagagatctctcgaggatccgaattcgcggccgcgtcgacgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatgggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtcaaaaaaaaagtcgacgcggccgcgaattcggatcctcgagagatctctttttttgggtttggtggggtatcttcatcatcgaatagatagttatatacatcatcgtcatctatcggggtcaatggggcgcggcggggggggggg

SEQ ID NO: 664 - DNA, 1572 bp, Homo sapiens
  CDS (330)..(704)
atagggaatttggccctcgaggccaagaattcggcacgagctcctgtgagacgggcttcccacctacagaagccacagcacctggactcttgggccagcaggggcttccaccacatgttgaccaagactagtgcctaagactaacaggggaagtggggacaggttgaggacacagggctgtgtgggtggatcaatgtggccaagttctgagtgccagctcctcagcctcccaggctggtgagcagctggagtaccggtccaccggaccggaattcccgggtcgacccacgcgtccgggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgagggggtgctggcctccccagggtttgccttcttacggatttagacgaggttcgaggctcacctatcagggcagctctcaggattgtcattttcctctttgccctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattcacaaaaaaaaaaaa

SEQ ID NO: 665 - DNA, 887 bp, Homo sapiens
  CDS (53)..(580)
  misc_feature (1)...(887): n = a,t,c or g
atagaanctcgatggcactggtccggaattcccgggtcgacccacgcgtccgatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatttgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaaaaaaaaaaa

SEQ ID NO: 666 - DNA, 3460 bp, Homo sapiens
  CDS (174)..(611)
tttgattaacgatacccaagctggctagcgtttaaacttaagcttggtaccgagctcggatccactagtccagtgtggtggaattcgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 667 - DNA, 1912 bp, Homo sapiens
  CDS (200)..(1390)
ggtaccggaccggaattcccgggtcgacccacgcgtccgctccaggacccagcagggccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgttgaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggataggctatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaaaaaaaaaaaaaa

SEQ ID NO: 668 - DNA, 2183 bp, Homo sapiens
  CDS (243)..(1694)
gtgagacccggccggaattcccgggtcgacccacgcgtccgcggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttctgtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgtttaaaaaaaaaaaa

SEQ ID NO: 669 - DNA, 719 bp, Homo sapiens
  CDS (81)..(578)
gtccgcacgaggaggcctgcgcccacaccctctcctgtccagccctcgcccgcctggtcagggcccggcgccatccgcggatgagccacagaacctcttccaccttccgagcggagagaagtttccattcctcttcctcttcctcctcctcggcctcccgtgctctcccgggccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctctggtcagtgtgccttagggtggcctctcactcccaccactctgggccccttgggggaggactggggagggggccgtgggagagccctgacgctggaacctgtatacacaataaaggacagtctcacagaaaa

SEQ ID NO: 670 - DNA, 772 bp, Homo sapiens
  CDS (24)..(665)
gcacgaggaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgccaaaaaaaaaaa

SEQ ID NO: 671 - DNA, 1482 bp, Homo sapiens
  CDS (20)..(1192)
cgacccacgcgttcgcgcgatgctggcgacgctggcgagggtggcagctctgcgcaaaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgccccccctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaagaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagatttaatttttttcctggaaaaaaaaaaa

SEQ ID NO: 672 - DNA, 1232 bp, Homo sapiens
  CDS (65)..(991)
gatcgacgtctgtggcactggtccggaattcccgggtcgacccacgcgtccggctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtcaaaaaaaaa

SEQ ID NO: 673 - DNA, 2900 bp, Homo sapiens
  CDS (66)..(2762)
ctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggcaaaaaaaaaaaa

SEQ ID NO: 674 - DNA, 4929 bp, Homo sapiens
  CDS (155)..(3541)
aaagctggtacgcctgcaggtaccggtccggaattcccgggtcgacccacgcgtccgcccacgcgtccgcaccaagttaatactgctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcaaaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggggacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatag

SEQ ID NO: 675 - DNA, 3039 bp, Homo sapiens
  CDS (169)..(2502)
  misc_feature (1)...(3039): n = a,t,c or g
gcacgagggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagctcctggcctatctcattgcagaccagggccagctcctgggggccggcaccctcaccaacctctctcaggttgttcgccgcaggacccagcggaggaagtccaccatcactgctctgctcttcggggaggatgacctggaggcactcaaggccaagaacatcaagcagacggaactggtggctgacctccgggaagccatcctgcgcgtggcacgccacttccagtgcacagaccccaaaaactgcagcgtggtgagtcgccagctccctgggctgctaccaaacacggccctaactcctccaacccccttggtgggcctgtgttcactgtggcaggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgagaaagcacctacctgtcttctgtgcagctagggctgcagagctgtattcaggtccaaggttctgcccttccttgagtggtttagaaggcactgcgtggcccctcagatgctgggacacaacagacccgggacccagctgtgctacccaccccttccatggactgaataagatggnctaccaaaaaaaaaaaa

SEQ ID NO: 676 - DNA, 2955 bp, Homo sapiens
  CDS (169)..(2418)
  misc_feature (1)...(2955): n = a,t,c or g
gcacgagggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagctcctggcctatctcattgcagaccagggccagctcctgggggccggcaccctcaccaacctctctcaggttgttcgccgcaggacccagcggaggaagtccaccatcactgctctgctcttcggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgagaaagcacctacctgtcttctgtgcagctagggctgcagagctgtattcaggtccaaggttctgcccttccttgagtggtttagaaggcactgcgtggcccctcagatgctgggacacaacagacccgggacccagctgtgctacccaccccttccatggactgaataagatggnctaccaaaaaaaaaaaa

SEQ ID NO: 677 - DNA, 4724 bp, Homo sapiens
  CDS (123)..(3701)
cggatgatgtatataactatctattcgatgatgaagataccccaccaaacccaaaaaaagagatctctcgaggatccgaattcgcggccgcgtcgacagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagtggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtggaacactgagcaggacaactgacctgtctccttcacatagtccatatcaccacaaatcacacaacaaaaaggagaagagatattttcggttgaaaaaaagtaaaaagataatgtagctgcatttctttagttattttgaaccccaaatatttcctcatctttttgttgttgtcatggatggtggtgacatggacttgtttatagaggacaggtcagctgtctggctc

SEQ ID NO: 678 - DNA, 4499 bp, Homo sapiens
  CDS (123)..(3476)
cggatgatgtatataactatctattcgatgatgaagataccccaccaaacccaaaaaaagagatctctcgaggatccgaattcgcggccgcgtcgacagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtggaacactgagcaggacaactgacctgtctccttcacatagtccatatcaccacaaatcacacaacaaaaaggagaagagatattttcggttgaaaaaaagtaaaaagataatgtagctgcatttctttagttattttgaaccccaaatatttcctcatctttttgttgttgtcatggatggtggtgacatggacttgtttatagaggacaggtcagctgtctggctc

SEQ ID NO: 679 - DNA, 4499 bp, Homo sapiens
  CDS (123)..(3476)
cggatgatgtatataactatctattcgatgatgaagataccccaccaaacccaaaaaaagagatctctcgaggatccgaattcgcggccgcgtcgacagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagtggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcgtgctgatggaagtggaagagcctgaagtcttacaggactcactggatggatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtggaacactgagcaggacaactgacctgtctccttcacatagtccatatcaccacaaatcacacaacaaaaaggagaagagatattttcggttgaaaaaaagtaaaaagataatgtagctgcatttctttagttattttgaaccccaaatatttcctcatctttttgttgttgtcatggatggtggtgacatggacttgtttatagaggacaggtcagctgtctggctc

SEQ ID NO: 680 - DNA, 1370 bp, Homo sapiens
  CDS (122)..(1054)
atttaatactgactcactatagggaatttggccctcgaggcaaagaattcggcacgaggtgagcggtctgcggcgcgcacgtgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaa

SEQ ID NO: 681 - DNA, 979 bp, Homo sapiens
  CDS (339)..(977)
tattgctcgcctgcggtaccggtccggaattcccgggtcgacccacgcgtccgtccctttctctttcctgcatgatgtctgctgccttcaatgccttgctgtgttgctggggatctgctctgtttagacttggctgccggtggcaccattttggcgtttaacacatttgtatatgtggcaccattggggctttggcaccatttggacttagctgcctgtggagctgtttggaactgagggatagaacgcaaggatctcacttagcccagtggatggcagtcaattaatggagcgagtggcttagtccttgtcatgctgccaagtgcaagggcctttccatgctcagaatcaccatgaagacgagagctatctctcttgctgcagacgccacggagtttgtgcaggggcgcagcgctccagccatggcgcgttcgctcgtccacgacaccgtgttctactgcctgagtgtataccaggtaaaaataagccccacacctcagctgggggcagcatcaagcgcagaaggccatgttggccaaggagctccaggcctcatgggtaatatgaaccctgagggcggtgtgaaccacgagaacggcatgaaccgcgatggcggcatgatccccgagggcggcggtggaaaccaggagcctcggcagcagccgcagcccccgccggaggagccggcccaggcggccatggagggtccgcagcccgagaacatgcagccacgaactcggcgcacgaagttcacgctgttgcaggtggaggagctggaaagtgttttccgacacactcaataccctgatgtgcccacaagaagggaacttgccgaaaacttaggtgtgactgaagacaaagtgcgggtttggtttaagaataaaagggccagatgtaggcgacatcagagagaattaatgctcgccaatgaactacgtgctgacccagacgactgtgtctacatcgtcgtggactagcc

SEQ ID NO: 682 - DNA, 866 bp, Homo sapiens
  CDS (176)..(706)
atttggccctcgaggccaagaattcggcacgagacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgcccttgagggggtctcagggcagcagcatacaaggtggcagcgggtaaccctgccttgttctgtcatccagggctcctttgctgccccgttctgtcacccagggctcctagggggacaaggctctctcccgaggggtgtggaatt

SEQ ID NO: 683 - DNA, 878 bp, Homo sapiens
  CDS (157)..(717)
  misc_feature (1)...(878): n = a,t,c or g
gagcgggtattgannctactgaccggctgtatgaattcggcacgaggccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaaaaaaaaaaaa

SEQ ID NO: 684 - DNA, 2002 bp, Homo sapiens
  CDS (93)..(1553)
atttggccctcgaggccaagaattcggcacgagggctgcgataatagcgaggcagcagtgcagctttcagagggtccgggctcagaggggctatgattcggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacgtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagaggcaggagggagccaaagtttctctgatgtctcctgatcagcttcggaacaagtttccctggataaacacagagggagtggctttggcgtcttatgggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttcaaaaaaaaaaaa

SEQ ID NO: 685 - DNA, 1003 bp, Homo sapiens
  CDS (454)..(696)
attgacggcaagccgtacgcctgcaggtaccggtccggaattcccgggtcgacccacgcgtccgcaaaaatgtaaaattagccaggcgtgggggcatatgcctgtaatcctagctacgtgggaggttgaggcaggaagatcacttgagcccaggagtttgaggttgcagtgagctatgattgtgccactgtattccagcctgggcagcagagtgagatgctatttcaaaaaaataaagtaaattaaaaaaaaataagagcctttgatggcaaatgttagaaaaatatgtaaataaaaacattggcacttttaaataggtcatcctgtcccaaagaggtagtgtttcccccaatacccacagcccctcacacaggcgtgtgcgcacacactcacggctcatggatcctgttttggtgaaccggactgacttcttcttgcctgccactccaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttctttttttttttggaaacaaagctttgttttttcccccaggagggagggcagggggctaaaatggccccactgaaccccacccctctagcctggggaaaaaattgagactttgtcttttcaaaaaaaaaaaa

SEQ ID NO: 686 - DNA, 1501 bp, Homo sapiens
  CDS (114)..(1013)
gcgacctcgtttgcgcctgccgcccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttcaaaaaaaaaaaaa

SEQ ID NO: 687 - DNA, 1212 bp, Homo sapiens
  CDS (131)..(1027)
aaggatccttaattaaattaatccccccccccccccccccgggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaaaaaaaaaaa

SEQ ID NO: 688 - DNA, 2529 bp, Homo sapiens
  CDS (169)..(1134)
aagctggtacgcctgcaggtaccggtccggaattcccgggtcgacgatttcgtggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaaaaaaaaaaaa

SEQ ID NO: 689 - DNA, 495 bp, Homo sapiens
  CDS (14)..(421)
aactccctattcgatgatgaagataccccaccaaacccaaaaaaagagatctctcgaggatccgaattcgcggccgtgtcgacggacggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaaaaaaaaaa

SEQ ID NO: 690 - DNA, 816 bp, Homo sapiens
  CDS (287)..(628)
tcctctagagcggccgcaccctggccgatttgatcctcggccgcgacaccttgctgacccaacaaccctgggtgattcgcgaaggcggcctcaaagcactcaaggcctgggagccggagccgtgccgctggctgggttacaacgcgatcattcgtagttttgtccatgaagaccaggtcttggccaactccaacactgcgccctggcgccgcaagctggcaaccggcgttgccggtttcatggaaggcttcatgcactgactcgttccacccacaggggaaaacccatgagcatcatgcaattcaaagacacgctgaacaccccactgccagattcatcaccggtggcggtgcccctgggcgcgcccatcgccgtggcctccaccttgagcgtggagcacaacgatggcgtcgagaccggcatctgggcctgcaccccggggcgctggcgtcggcagatcacgtcccaggagttttgccatttcatccaggggcgctgcaccttcacgcccgacgacggggaaaccctgcacatacaagccggtgacgcactgatgttgccagccaatagcaccggtatctgggatatccaggaaaccgtgcgcaagacctatgtcctgattctgtaacgctttgatccttgatcgcctgccataaaaacagccctaaaaccgccaggaaatcgaaccatgaaagccattgccctgttgcccttgatgttggtggcctctatcagccaggccgccgagaccgtgaagatctataactggtcggactacatcgacgaaatcgtcgacagcgaagacgaaatcgtcga

SEQ ID NO: 691 - DNA, 3752 bp, Homo sapiens
  CDS (376)..(1596)
atttggccctcgaggccaagaattcggcacgagggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttattttttttcctgcataccagggccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcaccccgaggcagaggggccagcatttgcaaaggcacagagctaagaggagctgggcaaagaaaggaaagccagggaaggtggtgggagatgagtctcaaagctaagtagtggaagctgggcacagtggctcatgctggcaatcccagcactttgggatgccat

SEQ ID NO: 692 - DNA, 2930 bp, Homo sapiens
  CDS (137)..(1267)
ttcgtatagcgagacccaagctggctagcgtttaaacttaagcttggtaccgagctcggatccactagtccagtgtggtggaattcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaaggcaagggaggggtgttggagagccagtgcccttaagactggagaaagctgcaatttaccaagttgccttttgccactgtagctgaccaggggactaggttgtagaggtgggaaggccccctctgggcttgatcttgtgccattcttgaccttggacctgcttggttaaggagggagtgggccagaccagagtgcccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtcaaaaaaaaaaaaa

SEQ ID NO: 693 - DNA, 2693 bp, Homo sapiens
  CDS (137)..(1030)
ttcgtatagcgagacccaagctggctagcgtttaaacttaagcttggtaccgagctcggatccactagtccagtgtggtggaattcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaaggcaagggaggggtgttggagagccagtgcccttaagactggagaaagctgcaatttaccaagttgccttttgccactgtagctgaccaggggactaggttgtagaggtgggaaggccccctctgggcttgatcttgtgccattcttgaccttggacctgcttggttaaggagggagtgggccagaccagagtgcccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtcaaaaaaaaaaaaa

SEQ ID NO: 694 - DNA, 1371 bp, Homo sapiens
  CDS (358)..(696)
  misc_feature (1)...(1371): n = a,t,c or g
atcgacattcgaagctgtacgcctgcaggtaccggtccggaattcccgggtcgacccacgcgtccgctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtgtttgctgaggataatggcctcaagatccatccgtgttcctgcaaaagacatgatctcgctgttttttatggttgcacatcttttgttctaacgtttggtctttcaccctggttcctgacacagagcttcctaaatcccttggaattttctgggtgataggagtgtcctttgttctcatgaggtgactcttggtgggctccttatttggagactggtcatcaaaaaacctcactatgggtggaagcgttgtgctgtcagccccattccccatcctctggggtaggaaatggagctggagctcaatcatacctacgtgataaagcctccagaaaactccttgaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactgttttcctgggttccatgagctgttctagcaaatgttcaaacctgaggagggagttgtggggacctccaatttacagccagttggtcagatgcataggtgatgcttggccttgcacctggggtctgacatgcggatggtcctgtgtgactgagcccttaacctgtggagtctggtgctcactctgcttagggcttctcttgcctttttagtgtccttctaggcggccggacgcgtgggcggacgcgtgggtcgacccgggaattccggaccggtactacaggcgatcgacntacaggggtccaaanttaattct

SEQ ID NO: 695 - DNA, 2295 bp, Homo sapiens
  CDS (363)..(1988)
aataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtttcagtagaaacataagtcccgcgcgtcttgtgctgcgcgtgcgcaagcttttgggccctcccgagaaagggaagtgcattttcgcttccgtagcggtttccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgcgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaaaaaaaaaaa

SEQ ID NO: 696 - DNA, 2540 bp, Homo sapiens
  CDS (576)..(2150)
ggtggaattcgcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggaaaaaaaaaaaa

SEQ ID NO: 697 - DNA, 2426 bp, Homo sapiens
  CDS (338)..(1936)
ggtggacttctaactttttctgcacaggaatttggaagactttgttatggcaggtgccgtacttttactttacaaacaaacattaggggcagcccaggcagcacacctttctggatttaccaaaaatacacattttcctacttaagcttggtaccgagctcggatccactagtccagtgtggtggaattcgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaatactcaaaaaaaaaaaa

SEQ ID NO: 698 - DNA, 705 bp, Homo sapiens
  CDS (71)..(319)
atttggccctcgagcaagaaattcggcacaggctgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtaaaaaaaaaaaa

SEQ ID NO: 699 - DNA, 2359 bp, Homo sapiens
  CDS (94)..(1869)
gattcagtggcctttgaggatgtggctgtcagcttcacccaggaggagtgggctttgctggatccttcccagaagaatctctacagggatgtgatgcaggaaaccttcaagaacctgacctctgtaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaatactcaaaaaaaaaaaa

SEQ ID NO: 700 - DNA, 1725 bp, Homo sapiens
  CDS (179)..(1399)
tttgtatagcatagccaagctggctagcgtttaaacttaagcttggtaccgagctcggatccactagtccagtgtggtggaattcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacggggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagatttttctatattgtacagagtggggcaaaacacgcccccatttgctgccttttttattgccctgcaacgtcccatctatacgaggtgttggagaaggtgaagaaccctcccattcacgcccgcctaccaacaacaaacgtgcttttttcctctttgaaaaaaaaaaaa

SEQ ID NO: 701 - DNA, 783 bp, Homo sapiens
  CDS (112)..(384)
ggcgtgatgtatataactatctattcgatgatgaagataccccaccaaacccaaaaaaagagatctctcgaggatccgaattcgcggccgcgtcgacccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaaaaaaaaaaaa

SEQ ID NO: 702 - DNA, 2522 bp, Homo sapiens
  CDS (179)..(1606)
atgacccccttgacccatgtgtcctgggcgtgaaggcttgtcctggtagctgttatctgtgtagggacaggcaggtagctgctgcgatttggcgcatcgctgcaccatcaatcctgtgagttgttccaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccgtctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtgcttttaaaacctaccctattacctgacttgggtggggctttcaaaaagccaatccctttctggaaggcctgggagcctgttttgttttcattatggcccacttcatggtagccggggccggctttacaaaacattgttattggaaatgacacctgtgaacaccgttaaaaaccgctagacaaaactttaccgactgccacccatgtggaaatgaggcagcctgtaaccagatgtcagccgcctgcctttccgcctctcccccgagtctgctggagtagctgtgtcccaagatatttaaatacaa

SEQ ID NO: 703 - DNA, 870 bp, Homo sapiens
  CDS (109)..(714)
ggcggctgccgtgagctgactgacgttccgggaacgccgcagcagcccgcgccgcccgcaggctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacactatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaaaaaaaaaaaa

SEQ ID NO: 704 - DNA, 1869 bp, Homo sapiens
  CDS (161)..(1792)
atccagagtgcagatcccttggctgccaggtcatgtctctcttcctctcaactgctctcccgaccatataaggagaggcagctgctgggggcgtgcccaggatctaaagatagcttcccctgcctggaactctaaatgccaccctggagcgggagccgcaatggcacggctgcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaattgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaaaaaaaaaaaa

SEQ ID NO: 705 - DNA, 1765 bp, Homo sapiens
  CDS (7)..(1536)
gccatcatggcggcggccacgaggcctgtccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaaaaa

SEQ ID NO: 706 - DNA, 4055 bp, Homo sapiens
  CDS (2515)..(3519)
ctttttttttttttttttttcctgtaggaaaatttcttacaccaaaggaagaaagagtttttttcccccctccccccctaaaattttttttttttttcaaaggggtaattttttttgggggggggtgggccaaatttcccccccccaaaaaaaagttttttttccaaaattcccccaagggttttttttttccccccctttaaaaaaaaaaatttttttttttttccccccttttttttgggcccccccgggttttttttttaagggccccccccccttttttttttttttttttttttttttttttttttttttttttttttttttttttttttttttctaaaagccaatttaataaattaataaacgcatgccagaaaaaataccaaattacaactgaaaaccaataataatttaacagaaaatgctgtgttgtacactttttattggtatggataacctttattaaagtaacaaatctgaaaacacattttgcttttgctggaaagaaagtactatgttagagaagaactaagagaaaccagaaatcatttgtaaaatgtaggcatgtgatatggtttatggtaatgtaacagccagaggtgctgttttatccatttgtgtgtgcgtgtttgtacaagcatcagaaaccaatgacatagaccccaaaagcaaagtcacaacaggcttactctgtgaaacatgctggattacaagcacagactacccaggacgcagaggcggtgcaggcgcaggtttgttgtttcttctgtatggggtttccttgccagatagggggctaatcatgcaatagcttgagtttctctgaacgtgataaacacccaggattactagaaccagaaagcgtgtgttcactgttttacaagacagctgagcggtgctacaaaaacaacagaaagttccttcactttaatctggttatatgcccaaacctctaatcaagaaataatgcagctacaggagcaaattaaattactataaaacattccttcatctgtaaaacatttcttttcccctcaaattaaaaatttaaaataaaatgtcttcgtttttgataagcagctccaccaccagtctctgataccgtatatcattcaatgcagccatggcgtctagttctggagatctcataagggtgggtccaaagacgattccaaggttctctgcattcataagattctccttttcgtggagggtcactctctttagatgtgccatgaggtaccggagggtttccgcagtgagcaggtggcagtagtttcagtgcttcatgaagggtttcccaattgctcatccggatccataattttggcagattctataaacttagggtaggcatcatatgtaatgagtggaattggcaaatccctgaagtacagtttaagtgcaccagtgataatgttgatatcttcatacatgttcacagaaatatctgccttctcaccatctctgtcgaaagccatcttgacatcttcaattaggtcactaaatcctgatactcggtatagtccttcagaattaagacctctagactcaatctccctgatgcacatgtctaccaccattggccgcttagtggtatgtgctttcacgagcgtcgtaaggtcacagctgtacacctttttgacatgcttcaagtctggcttacagtcatttgggaccatcttggaacactgcttatgaacattcaaaccacaatctgcacatttcactccctgagcaatgagaccccacataaagttggcacagtattcacaccagtgtggccctctgaatgtatgcaccttgaaattgtgaatcttttcatattttggaatttgctcgttttctttcagagttgctcttctaacaagtgatgtcaactgcgaataagcaaagagtttcagaggttgccagattgtcacagacgactttggagaacccagtttcattcccaaggctgctatcaataaatcttgctgacggccctcttgttttgatttgtgaactgcagccctattagtttccctcccttccccccaccttccctgctaggggcttcatagggtgtctgttgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctgggttctcttagttcttctctaacataga

SEQ ID NO: 707 - DNA, 768 bp, Homo sapiens
  CDS (109)..(486)
atttggccctcgagcaggaattcggcacgaggccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaaaaaaaaaaaa

SEQ ID NO: 708 - DNA, 1274 bp, Homo sapiens
  CDS (704)..(1081)
  misc_feature (1)...(1274): n = a,t,c or g
ccgcggcttgtgttgcctcctcgctggagaacaccctggtcgacctctgtgcgtccgtgtgcgcgancgtcccgccgagggttgggcagggcggacggtgcgcagtggttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggttaggagaggaaggaccaagggacggggcgttcccaggtgggagcctggagggcaaagcgtggtgcgagcagcctcgcgggccgcctaactgccccgttccaagggtgccaccggaccccgctggagaggaacttctccgttggctgatttcatcaccacccattcccgattccacgtttcctttaagcggggctggcggagccgcaaggcggcaaggaactggattgcgattggtcagcacgtgcctcggtccgcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagccccggggcctgctgcctccagcagccacttcagagcccccggcctttgcctgcactcctcttgcagggctggccctgcctgctcctgcggcagcctctggtgacgtgctgtccaccaggccttggagacaggctagcctggccacagaattaaacgtgttgccacacctgaaaaaaaaaaaa

SEQ ID NO: 709 - DNA, 707 bp, Homo sapiens
  CDS (339)..(698)
taagcttgcggccgcggcggtggcggagactgtggctttaagagcgtgccgggagcccgagccccagccgggccgcgcttcgccgctgcgcaccccagcggagccaagccccacgctggccggacagggccgcctgtcgccgggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaagtcattccaaggaagtcaaggacgagcatacctctttaactcagtagttaatgtgggctgtgggcctgcagaagagcgagtgttgctaacaggactgcatgcagtcgcagacatttactgtgaaaactgcaaaaccactctgggctggaaatacgaacatgcttttgaaagcagccagaaatataaagaaggcaaatacatcattgaactagcacacatgatcaaggacaatggctgggactgattggacagc

SEQ ID NO: 710 - DNA, 1404 bp, Homo sapiens
  CDS (104)..(916)
atttggcctcgagcagcaattcggcacaggggtgtgggggaggtagcccgcagtgcaggggcagcgcggcgcggggccaccgacgggacgcggctccgggaacatggctcgcttcgctctgactgttgtccggcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaaaaaaaaaaa

SEQ ID NO: 711 - DNA, 1745 bp, Homo sapiens
  CDS (124)..(1506)
taatacggctcactatagggaatttggccctcgaggccagaattcggcacgagggctgttgtgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttataaaaaaaaaaaaaaaaaacgaaggcggccgcaagctta

SEQ ID NO: 712 - DNA, 1748 bp, Homo sapiens
  CDS (187)..(1467)
ttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaaa

SEQ ID NO: 713 - DNA, 3169 bp, Homo sapiens
  CDS (116)..(2146)
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaa

SEQ ID NO: 714 - DNA, 3137 bp, Homo sapiens
  CDS (179)..(1909)
taagcttgcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagagccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaaatgcaagtgactaaattcaattattgactaatttccactttttatccatgacttctccaaatcaaaccacagtatatgttgtaacaaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgttgcaacaacaaagaaactgttcacttttcaaataaaatgatatgtcagggaattc

SEQ ID NO: 715 - DNA, 1981 bp, Homo sapiens
  CDS (59)..(1585)
cccacgcgtccgggcggctgacgtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgaaatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctttatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtatagagaaaaaaaaaaaa

SEQ ID NO: 716 - DNA, 956 bp, Homo sapiens
  CDS (171)..(764)
  misc_feature (1)...(956): n = a,t,c or g
gcgggnnttcgagtcatagtcagtgtggtggaattcgtagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaagctt

SEQ ID NO: 717 - DNA, 1042 bp, Homo sapiens
  CDS (71)..(676)
aaggatccttaattaaattaatcccccccccccccgaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatg

SEQ ID NO: 718 - DNA, 1012 bp, Homo sapiens
  CDS (71)..(646)
aaggatccttaattaaattaatcccccccccccccgaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatg

SEQ ID NO: 719 - DNA, 772 bp, Homo sapiens
  CDS (16)..(684)
gagctatgacgtcgcatgcacgcgtacgtaagcttggatcctctagagcggccgcctactactactaaattcgcggccgcgtcgacgaggaagagggcggcgacggtggtggtgactgagcggcccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccaaaaaaaaaaaa

SEQ ID NO: 720 - DNA, 1055 bp, Homo sapiens
  CDS (257)..(706)
actccggatttttcgggtcgacccacgcgtccgcggtgactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagcaaaaaaaaaaaa

SEQ ID NO: 721 - DNA, 5571 bp, Homo sapiens
  CDS (274)..(2760)
gtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaaaccccccaaaaacctggagtctcctaggggacactttgggcagcacggttatgttaggtaaagttttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtaatgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcaaaaaaaaaaaa

SEQ ID NO: 722 - DNA, 1509 bp, Homo sapiens
  CDS (557)..(1312)
  misc_feature (1)...(1509): n = a,t,c or g
ttggacgccngcggaccggcttgatcgcctgcggtaccggtccggaattcccgggtcgacccacgcgtccggggtcctgggcccaggaaccggcccggagccgtggacgccctacagctgagaaggggacccaaggggtcggccgcggccaaggcccctaggaccgccgccccagctcacgctgccgacggcagctatagacattctgcgtcaggtccgggctcctggacttcgcctttcccgagccctggaggtggggagaaaaggttcaccaatttttaaaatccaaatatatctcatggtacagtggaagaactggccagagagtctggaagtttgggttctggtcctggctgtgccactgactcactgtgaccttgggatcttgtgctgtgaagacatttcccaagtgcttcatgttagccagcaaatctgacccacaaggcctggaaagaggtgattgttaggttgcgcagaggtggtcttatccagctcagcttcccctgggacccaccgtgggacctgaggcagaactggggtggacttggcctcctccatggcacaccggctgcagatacgactgctgacgtgggatgtgaaggacacgctgctcaggctccgccaccccttaggggaggcctatgccaccaaggcccgggcccatgggctggaggtggagccctcagccctggaacaaggcttcaggcaggcatacagggctcagagccacagcttccccaactacggcctgagccacggcctaacctcccgccagtggtggctggatgtggtcctgcagaccttccacctggcgggtgtccaggatgctcaggctgtagcccccatcgctgaacagctttataaagacttcagccacccctgcacctggcaggtgttggatggggctgaggacaccctgagggagtgccgcacacggggtctgagactggcagtgatctccaactttgaccgacggctagagggcatcctggggggccttggcctgcgtgaacacttcgactttgtgctgacctccgaggctgctggctggcccaagccggacccccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcctagagggctcaactccagggctttgaggccagtgagggaagtggctgggccctaggccatggagaaaaccttaaacaaaccctggagacagggagccccttctttctccacagctctggacctttccccctctccctgcggcctttgtcacctactgtgataataaagcagtgagtgctgagctctcacccttccccccctaaaaaaaaaaaaaaaaaaaaaa

SEQ ID NO: 723 - DNA, 1660 bp, Homo sapiens
  CDS (127)..(1401)
gagattatagaaccttaggcctatttaggtgacactatagaacaagtttgtacaaaaaagcaggctggtaccggtccggaattcccgggatatcgtcgacccacgcgtccgactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaaaaaaaaaa

SEQ ID NO: 724 - DNA, 1496 bp, Homo sapiens
  CDS (130)..(993)
aaggatccttaattttattaatccccccccccccccccccggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccaggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggtgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactccaaaaaaaaaaaa

SEQ ID NO: 725 - DNA, 1110 bp, Homo sapiens
  CDS (121)..(639)
ttcgtggcggctgagctgtgctgcgcggcgcggcgcggcgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctacactgggccaccgcaacccatgggtggccagggattctggtgagtgagtgctgcgtggaacacgtggccagagggccctgctgtccttgtgttctgtccaggaacttgtatcctatcctgcctgcatttcctctgactgcaggcactgccgtggcaccatagagaggatacagaaggcctctctcattatttgtgtgtttaagtgggagggcacttccagtgacagatctttaagaaagagagggctcactcaaccacagcaaaggccagacctctctttgggcaacatgaaattcttgactacacgataatgttgattttgaaaaattatgattgaatttactagaaatggcctgtgttttaactgtgtttttataaatgaggttcaggccggttgcagtggctcatgcctttaatcccagtgctttgcaaggcctaggcaggaggattgcttgaggccaggagttcaagaccagcttgggtaacatggtgagacccctatttctaaaaaaaaaaaa

SEQ ID NO: 726 - DNA, 1927 bp, Homo sapiens
  CDS (88)..(1224)
gccaacatcttatcatctccttctaaaagaggacagaagggtaccctaattggatattctcctgaaggaacacctctttataacttcatgggtgatgcttttcagcacagctcccagtcaatccctagatttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcatgaatgctaacatgaggggtgtatttctacatgttttggcagatactcttggcagcattggtgtgatcgtatccacagttcttatagagcagtttggatggttcatcgctgacccactctgttctctttttattgctatattaatatttctcagggttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcgaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtg

SEQ ID NO: 727 - DNA, 466 bp, Homo sapiens
  CDS (125)..(346)
atttggccctcgaggcaagaattcggcacgaggaccaatctgaagtgggagcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgcaaaaaaaaaaaa

SEQ ID NO: 728 - DNA, 1493 bp, Homo sapiens
  CDS (397)..(1341)
atagggaatttggccctcgaggccaagaattcggcacgaggaaggctgaactgctgagtctgacacttaacaggacttcggcattcccctgaatacagactagatcagagattttatttttttaattgaaaagtaacttgggttctctttagaaacccttatttggtgtgcgcatctggctatttcacagagatttcagttttgcaaagaagtcggagttgatttcttccctcagacaagctattggttgttggtgggcaacagaagttgctcagcatagacaggggaaaaaacggttacggatgagactgaaagaaaacctcaaaggagaactctgagaattcatctcaggatgaagctgcaagggcaaaggagaagtacttgtgacacaagcaaatgggtccattgatcaacagatgcaagaagattcttctcccaactactgtacctcctgcaacgatgagaatctggctccttggaggcctgctgccattcctgctgctcctctctggcctgcagagacccacagagggttctgaggttgcaattaaaatcgacttcgacttcgcaccaggttcttttgatgatcagtaccaaggctgtagcaaacaggttatggagaaactaactcaaggggattatttcacaaaagacatagaagcccagaagaattattttaggatgtggcaaaaagcccacttagcctggcttaaccaaggaaaagttctaccccagaacatgactaccacacacgctgtggctattttgttttatacattgaacagcaatgttcattctgactttactagagccatggcctctgttgccaggactccacagcagtatgaacgttcattccacttcaaatatttacactactacctcacctcagcaatccagctgctgaggaaagacagcatcatggagaatggcactctgtgctatgaggtgcattataggacgaaggatgtccactttaatgcctacacaggggccaccattctatttggccaattcctctccacatccctcctgaaagaagaggcacaggagtttgggaaccagacactatttaccatattcacctgcctgggtgcacctgtacagtacttctccctcaagaaggaagtcttgatccctccctatgagctgtttaaagttataaatatgagctaccacccaagaggagactggttgcagttgaggtcaactgggaacctgagcacatataactgtcagctgctaaaagcttccagcaagaaatgcatccctgatcctatagctattgcatctctctcctttttgaccagtgtcatcatcttttccaaaagcagagtataaagaaatcttgtggctccttttatttaaaaaaaatatttaaataaaatcttttttattggccttttggctagaaatggacatttattttccaggaaggatgatcccatcatacttctgctgaaaccagcgcatggccccctctttgctaattc

SEQ ID NO: 729 - DNA, 1442 bp, Homo sapiens
  CDS (228)..(1352)
  misc_feature (1)...(1442): n = a,t,c or g
ggttgcggaccggtccggaattcccgggtcgacgatttcgtgctgcacgacgcctgtgtgtctggcctttccttctttttcttttccccggcagcacagtgtggctgtttgtctccttgcccgccaaagttctgcacgagcggagtcttattgtgtcgttatttggacaagaggcacattgacccaatttggagacgtattttcgaaggaggtgtgaaaaagacagcatgaactttaccccaacacacacccctgtctgcagaaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaaggtaatgtccttatgtcgtaacgaagttgtttatttttctgggagagttgaaggaattccaaagaacctacaatttgtaatgtaagatccattcagtccaggaagctctggtagcagctgcctcaagaactaggtttcaaagagcagctgatcgttgtagtatttggngattcaa

SEQ ID NO: 730 - DNA, 1909 bp, Homo sapiens
  CDS (147)..(1511)
taagcttgcggccgcaggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccataaaaaaaaaaaa

SEQ ID NO: 731 - DNA, 1238 bp, Homo sapiens
  CDS (175)..(768)
ctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctgggggcttctgcgctgttgttggggaagggaccccagtcctgccttccaccccccaaccaggcctgagactgatcaaacaataaacacgtttcccactctgaaaaaaaaaaaa

SEQ ID NO: 732 - DNA, 1038 bp, Homo sapiens
  CDS (62)..(925)
atcgtagaccactagtcagtgcggtggaattcggcagtcttcggccattcctgtagccagtatggagtttgcagccatatgtctcagaaatgccttgttgctgctacctgaagaacagcaagatccaaagcaggaaaatggggctcaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaaaaaaaaaaaa

SEQ ID NO: 733 - DNA, 2318 bp, Homo sapiens
  CDS (663)..(1691)
gcggggaattcataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacactggctgccaacaactctgcgttggccaaagccaacaacgacaccctggaggatatgaacagccagctcaactcattcacaggtcagatggagaacatcaccactatctctcaaggccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaacgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttccttttttttttttttgtcattttaccgacataatacatggagccaaagaaaacaataatggtactaataaaaactcctagggtttcctgtcagatttaaaaaaaaaaaa

SEQ ID NO: 734 - DNA, 1015 bp, Homo sapiens
  CDS (18)..(794)
ccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcttgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaaaaaaaaaaaaaaaa

SEQ ID NO: 735 - DNA, 2196 bp, Homo sapiens
  CDS (74)..(1465)
ggcacgagcggccctcccccgccccaccccgcgcgctccgctcgggcacgaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaaggtcctgtattaataggaagttcacatggtggtgtcaacattgaagatgttgctgctgagactcctgaagcaataattaaagaacctattgatattgaagaaggcatcaaaaaggaacaagctctccagcttgcacagaagatgggatttccacctaatattgtggaatcagcagcagaaaacatggtcaagctttacagcctttttctgaaatacgatgcaaccatgatagaaataaatccaatggtggaagattcagatggagctgtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctagtaaatggtgctggtttggctatggccacaatggatataataaaacttcatggagggactccagccaacttccttgatgttggtggtggtgctacagtccatcaagtaacagaagcatttaagcttatcacttcagataaaaaggtactggctattctggtcaacatttttggaggaatcatgcgctgtgatgttattgcacagggtatagtcatggcagtaaaagacttggaaattaaaatacctgttgtggtacggttacaaggtacacgagtcgatgatgctaaggcactgatagcggacagtggacttaaaatacttgcttgtgatgacttggatgaagctgctagaatggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttctttcgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatggaaaaaaaaaaaaaaaa

SEQ ID NO: 736 - DNA, 1006 bp, Homo sapiens
  CDS (147)..(842)
  misc_feature (1)...(1006): n = a,t,c or g
ggaacgtgcggatttcccgggtcgacgatttcgtcgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatggtgagtcgggggaggcccgggctctggcttcccgaccagcacccagctgggtctgcagagcagccctgggcagcggaatggggagagggaagcagaggccagtgatggaaaggggctgcctcacagcatagggagcaggaggggcggntctggcacccttccacttcatcgtcttagctggtccttagattggaaggtgaaggagactcagttggttaaagcaaaaacctaccgcccccttctcaccgccagtgacgcttgctccaacacttcccaccttcactaccggcgcctc

SEQ ID NO: 737 - DNA, 854 bp, Homo sapiens
  CDS (283)..(708)
acgcggaatcgagaccctagaccagcgtggcggaattcgtgcagttctgcagagaaacgtgggtgggtagcagagggacctagaggctgctagtccaaccttctgagctctgggcctttaactgaacacagatccttgaggatatggcactaatggagatttgggggctaactccaaacccctcactcacaaagggagatggaggtccagatagggcaccctaagtcacacagaaccaggcctcctgcaccccgttcattgctaatcccatagcactgggctatgagccctttgggactgggagtctccatggagtccaaccaagccttcacagggcaggggtgggagtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaacaaaaaaaaaaaaaa

SEQ ID NO: 738 - DNA, 1397 bp, Homo sapiens
  CDS (55)..(546)
atttggccctcgaggccaagaattcggcacgagggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaaaaaaaaaaaaaaa

SEQ ID NO: 739 - DNA, 703 bp, Homo sapiens
  CDS (268)..(456)
gcacgagggaggctgcttctgccccaggagggagaaacaccgactccctggctttggcgccagaagcctggatcggctgccaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtgtgagtctacctctttccttgtgcgtgtgcttgtgcttgtgtgtgagtgagtaattctcctctgtggagaaaggggggaatccatcaggtgatcttgtgccttcagtctttgcctccccttttgcaaagagggtctcaatctgaagttctcacatggggagccgggggagaattgaaatcataacggtggaaaaagaaggcccaggctctattcttacaggggtggattatcaaaggcaggggcctgccac

SEQ ID NO: 740 - DNA, 1794 bp, Homo sapiens
  CDS (312)..(641)
ttcgcaccggtccggaattcccgggtcgacgatttcgtgtggcaccatgagcagctcaggtggggcgcccggggcgtccgccagctctgcgccgcccgcgcaggaagagggcatgacgtggtggtaccgctggctgtgtcgcctgtctggggtgctgggggcagtcttcatctcccaaggccgccttcccagcgggctccgcctgcctccctgctgactcctgcccgtgtctcttgtttcaagcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtctggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttaacccacgtggggcttggcacaagcgggcggg

SEQ ID NO: 741 - DNA, 1162 bp, Homo sapiens
  CDS (144)..(602)
atttggccctcgaggccaagaattcggcacgagtgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaaaaaatttgtggtgataaaaatggaaaaataaaaatttggggagttaaaaaaaaaaaaaaaaaa

SEQ ID NO: 742 - DNA, 1912 bp, Homo sapiens
  CDS (340)..(1176)
cggcccggaattctcgggtcgacccacgcgtccgccggcagcaactcggcgcccgcggtccatggaccggaacctggggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctgggtttgttctgcagttctctcatccttatgatctgttgtgttgttttgattccatcattaatgcacttgttgagacttgtgataagctgctgctcctatatttttaagaaatataataaagcacttagggcaggggagatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataaaaaaaaaaaaaaaaaaagggcggccgctctagagtatccctcgaggggcccaagcttacgcgtacccagctttcttgtacaaagtgg

SEQ ID NO: 743 - DNA, 2091 bp, Homo sapiens
  CDS (128)..(1714)
ttacgcctgcggtaccggtccggaattcccgggtcgatccacacgatcgatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttaaatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactacagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggagggcaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctaaaaaaaaaaaa

SEQ ID NO: 744 - DNA, 1022 bp, Homo sapiens
  CDS (23)..(886)
gcacgagccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcaaaaaaaaaaaaa

SEQ ID NO: 745 - DNA, 631 bp, Homo sapiens
  CDS (94)..(522)
atttggccctcgaggccaagaattcggcacgagccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgaaaaaaaaaa

SEQ ID NO: 746 - DNA, 1403 bp, Homo sapiens
  CDS (230)..(1201)
gccgtaccggtccggaattcccgggtcgacgatttcgtccgccaatggcagagctcccatcgcagagcctgcgggttaggttgtagaggcccgggccgggggcggggaggagccaagggggcgagcaagctcggtggctgggtgggttggggcgttccgcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagaaatggatgatgaagactgtgaaagaagaagaatggaatgtttggatgaaatgtccaatcttgaaaaacagtttaccgatctcaaagatcaactttataaagaacgattaagtcaggtggatgcaaaactacaagaagtcatagctggaaaagcaccagaatacttggaaccgctggcaactttacaggaaaatatgcaaattcgtacaaaggtagcaggaatctatagagagctctgcttagaatctgtaaagaacaaatatgaatgtgaaattcaagcttctcgccagcattgtgagagcgaaaagctgttgctatatgatacagtccagagtgaactagaggagaagataagaaggcttgaagaggataggcacagcattgatattacctcagagctgtggaatgatgagcttcagtcaagaaaaaagaggaaggatcctttctggcctgacaaaaagaagccagttgttgtttcaggtccatatatagtttatatgctacaagatcttgatattcttgaagactggacaacaattaggaaggcaatggctacattggggccacacagagtgaaaacggaaccacctgtgaaactggaaaaacatctgcacagtgctagatctgaagagggaagactatattatgatggtgaatggtatatacgtggacaaacaatatgtattgataaaaaagatgaatgtcctacaagtgctgtaattacaacaattaaccatgatgaagtttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacgaaaaaaaaaaaa

SEQ ID NO: 747 - DNA, 1793 bp, Homo sapiens
  CDS (435)..(1472)
atttggccctcgaggccaagaattcggcacgaggtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatgacatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaaaaaaaaaaa

SEQ ID NO: 748 - DNA, 2095 bp, Homo sapiens
  CDS (136)..(897)
cattgatcaccctgcggtaccggtccggaattcccgggtcgacccacgcgtccgggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaaaaa

SEQ ID NO: 749 - DNA, 1619 bp, Homo sapiens
  CDS (161)..(871)
atgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggccagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaaaaaaaaaaa

SEQ ID NO: 750 - DNA, 1257 bp, Homo sapiens
  CDS (111)..(977)
cccgggtcgacccacgcgtccggaattttgatctaaatagcaaatctattctgcaggaatttttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaaaaaaaaaaaaa

SEQ ID NO: 751 - DNA, 2020 bp, Homo sapiens
  CDS (222)..(1196)
gctggctagcgtttaaacttaagcttggtaccgagctcggatccactagtccagtgtggtggaattcggccactgatcccccgaagagcttctgtcgccgctctaggaatacagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgcc

SEQ ID NO: 752 - DNA, 1874 bp, Homo sapiens
  CDS (271)..(1722)
ggagtttggagcctggagactgctagctgcctggttctttaagaaccagccttggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaaaaaaaaaaaa

SEQ ID NO: 753 - DNA, 2891 bp, Homo sapiens
  CDS (136)..(2136)
cggcacgaggagcggcccgcttcaggcctcagaatcactcttggagttagatatttaagaatccttcctgccttgacagccagtctgtgaaatgatggtgaggtgggcacttctttgtggtgagtgcagatctggatggagatttgtgaaggcaaggagattgaagactcgaggccaagaattcggcacgagggggcacttctttgtgaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttcttcgaaaacagggcattcacaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaaaaaaaaaaaa

SEQ ID NO: 754 - DNA, 1610 bp, Homo sapiens
  CDS (499)..(1278)
atgctgttacgcctgcaggtaccggtccggaattcccgggtcgacgatttcgtgaggcactggctgggctctgactgtcacgttaattccctgctgctttttctagtccccagccgcctcgcccctcctccctcattcccagcctgggtttggaggcgatttccctctattgactgagccgactgcatctctgggcaagcggcgctttgcctctctcctgtctttgtctgctcttcctgcagccctggcagcgggcacacccctaagcatacgcacccaacgcctcctccctgagccacgaggatggagcagccaccccggcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaaaaaaaaaa

SEQ ID NO: 755 - DNA, 1263 bp, Homo sapiens
  CDS (58)..(1221)
ccggaattcccgggtcgacccacgcgtccgaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccacaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtaaaaaaaaaaaa

SEQ ID NO: 756 - DNA, 1861 bp, Homo sapiens
  CDS (39)..(740)
atttggccctcgaggccaagaattcggcacgagtcgcgatggagggaggaggaggtatacccctagaaacacttaaagaagaaagtcagtcaagacatgttctacctgcaagttttgaagtcaacagtttgcagaaaagcaactgggggttcttacttactgggcttgtgggtggcaccctggtggctgtgtacgctgtagccacgccgtttgtaacgccagcccttcgaaaagtctgtttgccatttgtacctgcaactatgaagcagattgaaaatgttgtgaaaatgttgcgatgccgaagaggatcccttgtggacatcggtagtggggacggacgcattgtcatagcggctgcgaagaaagggttcacagcagttggttatgaattaaacccatggctagtttggtattccagataccgcgcttggcgagaaggtgtgcatggatctgccaaattttatatttcagatttgtggaaggttactttttcgcagtactcgaacgttgttattttcggtgtgcctcagatgatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaactttactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttcatggcaaaattaattttctaaaggattcagagaggcgtttatattttataacatttattagaaataatttgttccaccactagattactgtattttatggaatctaagctgtatatgtgtacatttgtatacatgtatgtgtaaatgtaagcctgacgtgggttcagattccagttttgtcatcagcaagaggcctcggacccatgacttactgcctctgagccttggctttctgtgtatctctgccactgggataatggtacacataacagtggagtggggatcaatttctaaaactcatggcacctagtctttggtccataaatggtgtttgttattttagacactgagaaaaatcttattcacagaagttgcagattatttctgctagtcacttttttatttcttgagagctgccactcatttaatatttctcatttatgagaagagacttgactgatttagataaaagacgaattaaggaaaacctttgaacgtgagtagacaagcttcatatatctgtaaagtgaatattgaatggtagcttgagtcattcgtacttatcacagaaaagaattgaactcccagtcatacacctgtaactgaaataccaaactgtcttaatggagatgtaatgaagtaagttggtcacatctttaactaaacttataaaaattggaaaaaaaaaaaa

SEQ ID NO: 757 - DNA, 1191 bp, Homo sapiens
  CDS (135)..(647)
  misc_feature (1)...(1191): n = a,t,c or g
cgccgcccgcnnnaattganatcgatagctgtacgcctgcggtaccggtccggaattcccgggtcgacccacgcgtccggcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgcaaaaaaaaaaaaa

SEQ ID NO: 758 - DNA, 1438 bp, Homo sapiens
  CDS (187)..(960)
ttgaactgactgccctcgaaacagcgtggtggaattctgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggaaaaaaaaaaaa

SEQ ID NO: 759 - DNA, 2045 bp, Homo sapiens
  CDS (381)..(1760)
gcactgctccggaattcccgggtcgacccacgcgtccggtggggacaggagctgggtgtgctggggactggccgcggacccctaacctgtgtctccggtctccctccgggagcggctcaacccagcccatcgctctggccccgttctggccctgcagggtggtggttgggacgttgaaatgagcgcgcgagtggtacgttctctctccgcgctcacgcccccctcctcaccgtgtttcccgccaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttgtccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctaccaggcgaaaaccacagattctccttctagttagtatagcggacttaataaaagaggaaaaaactcttaaaaaaaaaaaaaaa

SEQ ID NO: 760 - DNA, 3551 bp, Homo sapiens
  CDS (370)..(2139)
cctgcaggaattcggcacgaggccacacagagagatgccggcttctacaagtgcatggcaaaaaacattctcggcagtgactccaaaacaacttacatccacgtcttctgaaatgtggattccagaatgattgcttaggaaccctcaagctggactgcagcgcctcggggacccctggccgcgcatcctctggaggctgccgtccaagaggatgatcgacgcgctcttagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgagcacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttgcttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatcagcgagaagatcacggccatggcgggccacaccatcagcctcaactgctctgccgcggggaccccgacacccagcctggtgtgggtccttcccaatggcaccgatctgcagagtggacagcagctgcagcgcttctaccacaaggctgacggcatgctacacattagcggtctctcctcggtggacgctggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaaaccgggcagtgatgacaatgctattttcaaggacaaaagagggtctcatgaatctgggtttccatcagagcagttgaaaaaactgctttcattcactttctctcaatgattagcttctctacacatttttaacaggcaaggaaactgagtcaaaggcaatgcttctgatgacagatttggcaggcagggtttgagtgtcacttgcatgtagtgacaatttcagtatgcagcaagacagtgtggggactgagaagcagtgctc

SEQ ID NO: 761 - DNA, 2050 bp, Homo sapiens
  CDS (234)..(1445)
attgatagccgtacgcctgaggtaccggaccggaattcccgggtcgacgatttcgtccgcgggaggcagtggtagagggaggtggcggcagcggctagcggactcgagtctcaaccgggctgaggcggacacttctgtggagcgaagcagtgggagcatcgagcactagaggcgacaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactccccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctctttaaaaaaaaaaaaaaaa

SEQ ID NO: 762 - DNA, 942 bp, Homo sapiens
  CDS (66)..(605)
agtggtggaattcgagctacaacctgccagcctatgctccatacctgccctgcgaggcctgcgcgatgcaagacgggagaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcaaaaaaaaaaa

SEQ ID NO: 763 - DNA, 2372 bp, Homo sapiens
  CDS (128)..(1807)
catcgacatcgatagccgtacgcctgcggtaccggtccggaattcccgggtcgacgatttcgtcgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatgggagccagtttggtggttggcaaactaccagtgatagaaaacaaatgacaggttttctgtgagcgtacgtcacagtggctcgggcccacaaggagacagaggggtacgtttcaggacatcattccaagggtttctgttcacgtttgtttaacgaggaaggggaagttgttctcccataataccagtggtatttctagtgcaacccgggtgtttttctacgcctcttcccatgctgcttccccacccccccactgtgctccgccccttccaaatgccatgtcacaacagcacttggatgtgtttttctcaactgtcatcagctccagctggcaggaccaacttcttga

SEQ ID NO: 764 - DNA, 1960 bp, Homo sapiens
  CDS (511)..(1311)
  misc_feature (1)...(1960): n = a,t,c or g
agagttgccaggcttcnnnctccaggntntctaatngatactngaannnnccnnngnaggggcaggactggttgcagaggccacagagatgaccacaccagggcattctgtagtgccagtgcctggttccacccggggggcatctgagaactgtgtccttgcattcctgagtccagcacttcccaggccagccatcctaatgagtgtgaagtggtatttcactgtatttccctaatggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactaccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatggtttttccagcccaggacaagccaggtgagctgcaggccacactggaccacacggggcacacctcctccaagtccctgcccaatttccccatatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtggcaactaaaaaaaaaaa

SEQ ID NO: 765 - DNA, 1890 bp, Homo sapiens
  CDS (132)..(1844)
gagaaaattgaccttgatcccctgcggtaccggtccggaattcccgggtcgacccacgcgtccgatgatatggaaatattcatggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagc

SEQ ID NO: 766 - DNA, 2334 bp, Homo sapiens
  CDS (164)..(1837)
cgacccacgcgtccgatctgccttaccacttacctgttgtgggaccttgtgaaatttatgtaacctctctgtgcctcagtttgctgaactgtaaatgatcatgataaaaatatgtcctacctcatagaactgatgagaagattaaattagttaacatatgtaaatgtataaagcacttagaacagtgcctggctcttcggaagtgctgctgttattagcacagccttggctccagccttgcccccacctgcccactgcctctctgaccagtgacctgaccttcccttgtgtcccctctgaggagcagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggcggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggccgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgtgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgcttttttttttttaataaagaagaaatttaaaatcaaaaaaaaaaaaaa

SEQ ID NO: 767 - DNA, 1316 bp, Homo sapiens
  CDS (167)..(973)
tgaggaattcggcacgaggcctgcaggcccccggtacgatcagatccggactccggcccggactacgaggcgctgtcggctggagccactgtcaccacgcacatgtggggtatgcgccgagccatggatgctggagcactgcttgatgtaccccatcgactgcgtgatgacccggatgcatagtctacagtctgacccagctggccgctatcgcaatgtgttggaggtcctctggaggattataagaacggagggcctatggaggcccatgagggggctgaacgtcacagcaacaggcgcatggcctgcccacgccctttattttgcctgctacgaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaaaaaaaaaaaaaaaaaa

SEQ ID NO: 768 - DNA, 1844 bp, Homo sapiens
  CDS (164)..(1594)
gtaccggtccggaattcccgggtcgacccacgcgtccgctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaattgcaaaaaaaaaaaa

SEQ ID NO: 769 - DNA, 1071 bp, Homo sapiens
  CDS (120)..(890)
acgccccattgaattcgtaagcgttacgcctgcggtaccggtccggaattcccgggtcgacccacgcgtgcgaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcaaa

SEQ ID NO: 770 - DNA, 997 bp, Homo sapiens
  CDS (56)..(412)
tttcggagcctctggactttgaagcattcaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcggatgtcctcctctgtgaaactgggatgataataatgcctaccttgtgagggttgcttcaatgattaggaatcattctgtaaagtctagcagagttccttgcatgttgtagcagtgattcagtaagtagcaaccctgtgatactattaccaccacctgctcactggtcaaaacctacacagctgtttcctcacgtccatcacaggctctct

SEQ ID NO: 771 - DNA, 1384 bp, Homo sapiens
  CDS (24)..(518)
agagagcgcggtggaattcagacatgggggacctgccgggcctcgtgcgcctctccatcgcgctgcgcacccagcctaatgacggcccggtcttttacaaggtggacgggcagcgcttcggccagaaccgcaccatcaagctgctcaccggctcctcctacaaggttgaggtgaagattaagcccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccgttcacagacattgggaccttcgagacagtgtggcaagtcaagttctacaattaccacaagcgggatcactgccagtggggaagccccttctctgtcattgagtatgaatgcaagcccaacgagacacgcagtctgatgtgggtgaacaaggagtccttcctctgaaagtggctctttctgatgctactggacaatcttttcagaaatctacttttagataaaccagcgcaggccttaaacaaggcatgccacaccattgctgttccccatctggtactaatgacctactagccctggttattttgaaagtgtaattcccctctgacacaatatccctcacatacaagatggtgatgtaccactcccgagaatattcccatctgtattttgtgctgatgttcctgcatccagttgttctcggtcatacttttgaccacttgtgactggagttcagtggccctggcaggcttgtcctgctcttgaccattccactgactaactttggtgttttgtttccaagttaagtgattcctccttttttttgttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatcaaaaaaaaaaaaaaa

SEQ ID NO: 772 - DNA, 2321 bp, Homo sapiens
  CDS (370)..(1434)
atgaaaacccattgatagccgtcgcgcctgccgtaccggaccggaattcccgggtcgacgatttcgtgcgagaggagcccctgctctgttaacgctcttaatgtgctgcggctgccggcagaagctagcaggctcctctgctgaggagctggtgcctgtccagacgcagaagaaaactgacacctcccacgtgggggacagaaaggtcctctcattggtgccacctgcagagatagacaaggagcgcctggccatcagaggacgctcctgacagtgacacagtgaccactataaaagtcaggcgggctgaggaggagacaaaggccaggacgctccgcagctgttggggaagaggagctgcctcctgggatggagaaatttaaggctgcgatgttgctggggagcgtcggcgatgctcttggctacagaaatgtctgcaaggagaacagcactgtaggcatgaagatccaggaggagctgcaacgttccgggggcctggaccacctcgtactctcgccaggagaatggcccgtgagtgacaacaccatcatgcacatcgcaaccgccgaggccctcaccacagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgagggccaatgcacctccccccaccccccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgataaaaaaaaaa

SEQ ID NO: 773 - DNA, 2629 bp, Homo sapiens
  CDS (73)..(798)
tttcgtggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgcttctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagcgccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaatgggaatgtggtgttagttacgaccacggcctgaccctccagcaacctttctgcaggatcagttctgctgtattatctggtggtgctttctaaggtggggaaaggaattgcacttggctgcattaaatggacgctgggttacttttatttcccccccccacagggttgcagagcaaattctttttacattgttcagcgcccggctggagttgggggtgtccacgacctctgacagcccccgatgtcgaaagttaatcctcatggaccctagtttaaagggtgtgtgttttataggaataaatctaaagcactattttgtttctgtatagcatttttatcttttagaaacatcatttgttcagcattagtagtagttgtagtgcctgttttggtagccttcaaaattataaactgctcagagaatgtgacttttgagcgctttaggggtgcttggtcggaaaacagactgggtctgtggaaggaccacagacaggagagaacagctgctgtgacttagaagtgtagccggagtctcattccctggactcgccgtgttcacctgt

SEQ ID NO: 774 - DNA, 813 bp, Homo sapiens
  CDS (14)..(454)
  misc_feature (1)...(813): n = a,t,c or g
ctggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggccaaagaagatgaaacttgaacagaagaaacaagaagggactccggtcagctccaaggagcagggggtccagcagctcttgcggaggcatctggaacagaggaggaggaggggagtgccagtttcaccatggngcgatgacaaggttggcacagcctctgcctggaacctggtcgtgctgtgaccagaanaggaaaggcggctgtttgggctcttttctcctcgcangggaccngctgacccngctggatgggagagcaaggagancccctccngagcngntcacaagtctgattttggcaggtnnggagctganagggcatctncttgacactaaagcacttgcttgagaccacatcgtgcttcttggtaaggggacg

SEQ ID NO: 775 - DNA, 1109 bp, Homo sapiens
  CDS (441)..(929)
aagctggtacgcctgcaggtaccggtccgtatattcccttgtcgacccacgcgtccgccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaaaaaaaaaaaa

SEQ ID NO: 776 - DNA, 1125 bp, Homo sapiens
  CDS (110)..(754)
  misc_feature (1)...(1125): n = a,t,c or g
cgctggggcagccggggcagccggggcttccttatcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctggggctgggctggccttcttctacagttcaatatggggggcaggactaggggaaacctttggcttggcttaactatttagggagggggnaagtntttcagtaggggaaacacgattcattnccattgta

SEQ ID NO: 777 - DNA, 2521 bp, Homo sapiens
  CDS (58)..(1653)
cgttgcccaacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtaaaaaaaaaaaaaa

SEQ ID NO: 778 - DNA, 2504 bp, Homo sapiens
  CDS (391)..(753)
  misc_feature (1)...(2504): n = a,t,c or g
cctagatacgccactggatacacgtccggaattcccgggtcgacccacgcgtccgggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttacaagggacaaaatgatgcaaattatatgctgtccaacctactggtgaactggatcagaatggtccaaggactgttaaacagaggaagtatttacattttgaaaacttgctctgcaggataaaaaaattcctggttgctgtcagtaagaaagcaagtaaaaaaaatattacagatgaactcactgatctttgattttactaaggtcttccactggaacatgaaggtagggataagtgtacaggataatatactcagatatttttaaaataaattacttaataataagaaattagccataccacattgttccatttgctacaagaacaaattggcaatgaagactatttaaaagaaatgctcagctctacagagggtggtggcaggcaacacttttccattacagaataacctctattcttccatgatacatattcctgtggaaaaacttgtcagggcccagggatgaaaaatagagcttgtcctaattagctaactgtaggttcacttaacatctttgggaaggacccaaaaaatctggccattattttcttaaacatctgcaagctgcagaattccttagtcctcagctatagtttctgctagatatcttaaagctgggacagttccactgtgactcctcctcagctatggggtgggtgctagtcatcaaagtctggaatgtcatcataggagtaaccacggtagcctttggatgcatagtaagcgatgcgcaggtggtaaaatccgggtaggaacaccagaatgccaatgatcagcactggaacggcccggtctgccccccctttgctgatgtagcctgacagcaggagggagcctgaaggtcaatgtagccatcgtctgtgctggagagccttgaatatttcactttactactggggattccagtagccaggttggtacgggacggcatcataacacgctgacacagcggagcgccgcgccaggccgcccgcacacccagagctcgcccacggttggcagcgcccaaggttgcatggcatggcccgcttaagtgccactcagccgaattccnccacntggatagggatctcgatnggnnttcgattcccnnnnctccttcaatcaca

SEQ ID NO: 779 - DNA, 682 bp, Homo sapiens
  CDS (244)..(645)
gtggggaattcaacacatccgttgacacaaattccgagccaaatctcactcagattcggaagagccatgcacaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctggcatgccgaattcgctatgaacgggataacaacttcttagcaatgctggagaggcaatttattgtgagaaaggttcactacgatcctgaaaaagatgtacatatttacgaagcacagacgagaaaccagaaggaggacttataattggctataatttataagaatgttgtcattgagtgtg

SEQ ID NO: 780 - DNA, 3883 bp, Homo sapiens
  CDS (830)..(1933)
agggaaatttgaaaccgtagacctgcgttaccgggccggaattcccgggtcgacgatttcgtggctgtggagtgcagtggcgcggtcttggctcactgcagcctccgtctcccgggttcaagtgattctcccgcatcagcctccaagtagctgggactacagatgcgtgccaccgtgcccggctaatttttgtatttttagtagagacgggggtttcactatgttggccaggatgctctggaactcctgaccttgtgattcacccgcctcggcctcccaaagtgttgggattacaggcgcgagcccccacgctggctggtagggtgcagttcctcaagtgggattgtggatttgtaggactgcatgttgatgaaacctttgcagcctgggggcgggctctttgagtttgcaccccaaggaggtctgcatgagaagaaccctttctccaagtcctcccggacagaggtcgtcataaattatttttgttgcttaatgggcgaggcccctgatttggagtcagctgacttgggcccccagcccaggctcgtgtttatctgctgtgagatcctggacaagctgcttcaccttcccaagtcctgttgggagcatgagtgggaagtgctgctcccggaggtgcttggagggagaatgagagtatggcgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctc

SEQ ID NO: 781 - DNA, 910 bp, Homo sapiens
  CDS (192)..(662)
  misc_feature (1)...(910): n = a,t,c or g
aagggtcaaaattgaggctgtcgcctgcggnaccggaccggaattcccgggtcgacgatttcgtcccagcgcccaggaccgtgtctgggaaaaggtctttgcccggagagtgggaagagagaggggagggtgagcagaggacaggccgggagttttccgggaacggaggaagagcagtggaggctgccaggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggacacacgagcaggctggccgtcctcaggatcagcctgctgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaaaaaaaac

SEQ ID NO: 782 - DNA, 1041 bp, Homo sapiens
  CDS (283)..(954)
atttggccctcgaggccaagaattcggcacgaggggagggagacggcagcggcatggcggccgggtgtaagacgcccgaccctcctcttccctgtcttcgccgccgccgctgctggagtcactgggaccctctagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaaaaaaaaaaaaaa

SEQ ID NO: 783 - DNA, 1417 bp, Homo sapiens
  CDS (96)..(725)
ccatagggagacccaagctggttagcgcttaaacttaagcttggtaccgagctcggatccactagtccagtgtggtggaattcgaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaaaaaaa

SEQ ID NO: 784 - DNA, 715 bp, Homo sapiens
  CDS (58)..(636)
gagccggggagggagggagcgaggttctgacaccggcggtggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttaaaaaaaaaaaaa

SEQ ID NO: 785 - DNA, 1062 bp, Homo sapiens
  CDS (188)..(745)
agcccatgagtcgataccatagccagagcggtggaatttctgagcccgcggcggaccctcccgcgccccctctcgctctgcctctccctctgcctctgcctctgcctggccgcggctctgggaagtgcgcagtccgctcttgcccctgttctttgcttctcgttttgttggagaagatatcacagtgatgtctgcattcaacctgctgcatttggtgacaaagagccagccagtagcccttcgagcctgtgggcttccctcagggtcgtgtagggataaaaagaactgtaaggtggtcttttcccagcacgaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccccttgattcagaagca

SEQ ID NO: 786 - DNA, 1032 bp, Homo sapiens
  CDS (62)..(862)
gcacgagaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttaaaaaaaaaaaaa

SEQ ID NO: 787 - DNA, 991 bp, Homo sapiens
  CDS (85)..(555)
gcggccccatcgagatcgatatccgtgtggaggaattccctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcatgagctgaggaagaggtacaacgtcacagccatccccaagcttgtgattgtgaaacaaaatggggaggtcatcaccaacaaagggcggaagcagatccgggaacgggggttggcctgcttccaggactgggtggaggcggccgatatcttccagaatttctccgtttgaagtgggagggacctcagagggccaggacaggtgctgcttctccagcaccgacgctggggcaaagaggagcatgttgggttccttcctctgttggtgtgatttcattgtatttcagagcagaagcactaagctgtggtcaaaaagcaactattgctcaggaaataatacactccatattttgatcatgcaggctgtttgtattatagttatttttgttattctttgcatacctttatccacctgtgcttaaggaaggatcctcatatgttcatactgagctgttggaaatctatgcaagacatttatttgtacaagtctcttcaggtaaaataatatatttattgataacattttctggcgatctgtttattttaatggtatgctttcacaactatcttaataaagtttgcaagctgtgtactttaaaaaaaaaaaa

SEQ ID NO: 788 - DNA, 1462 bp, Homo sapiens
  CDS (109)..(915)
aacacgctacttgttctttttgcaggatcccatcgataagcttgcttgttcttttggccgaagcggcctacggctgcgagaagacgacagaagggggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgtaaaaaaaaaaaa

SEQ ID NO: 789 - DNA, 1519 bp, Homo sapiens
  CDS (109)..(972)
aacacgctacttgttctttttgcaggatcccatcgataagcttgcttgttcttttggccgaagcggcctacggctgcgagaagacgacagaagggggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagagatagcatttcaccatgttgcccaggctggtctcgaactccaccatgcccagccagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgtaaaaaaaaaaaa

SEQ ID NO: 790 - DNA, 1321 bp, Homo sapiens
  CDS (109)..(774)
aacacgctacttgttctttttgcaggatcccatcgataagcttgcttgttcttttggccgaagcggcctacggctgcgagaagacgacagaagggggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaaggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgtaaaaaaaaaaaa

SEQ ID NO: 791 - DNA, 1379 bp, Homo sapiens
  CDS (109)..(789)
aacacgctacttgttctttttgcaggatcccatcgataagcttgcttgttcttttggccgaagcggcctacggctgcgagaagacgacagaagggggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgtaaaaaaaaaaaa

SEQ ID NO: 792 - DNA, 3883 bp, Homo sapiens
  CDS (2307)..(3542)
gagatggagactcgctctgtcacccaggctggagtgcaatggtgagatctcggctcactgcaacctccacctcctgggttcaggcgattctcctgcctcccaatcctagtagctgggagtatcaggtgagtcgcagccccaacgcacgcccggcataatttttttatttttagtcgagacgggtttcaccacgttggccaggatggtctcgaactcctgacctcaggtgatccacccgcctcggcctcccaaagcactgggattacaggcgtgagccaccgcgcccggcctccatatccattcttgggaacacttgttgcttagctgaacggagcccgcatcctgctgtggcggcactcgccccggtgctggtctgagcagacgcctcctttctcttgcagaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgtaaacccgaattcgggaccatcacagtttgattagcctcagcctcaagagctggcacatgcttgtgaacttgtgctttcatattttcctaacctgtgtgctctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcaggcagcgaacattaagaattacggcagtcggccaaacgcaccctattgctggatggcatgggaaccctccttgggagccttctatgggccagccagcttcagcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgttattgtgtcaaaaaaaaaaaa

SEQ ID NO: 793 - DNA, 1854 bp, Homo sapiens
  CDS (210)..(830)
attgaaaactgatagcctgcggaaccgcgtccggaattcccgggtcgacccacgcgtccgagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagataaagtcgcaaatggagacatttattttcataatgctaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattataaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagttttttttttttt

SEQ ID NO: 794 - DNA, 1005 bp, Homo sapiens
  CDS (48)..(917)
gcgatggaccggtccggaattcccgggtcgacccacgcgtccggaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgaggaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggccccccaagggagtggcagggagatggcgcccctgcttttccctgagcctctcgcctgctcctcttgggtctcttggctgct

SEQ ID NO: 795 - DNA, 2194 bp, Homo sapiens
  CDS (140)..(1189)
cctgcggtaccggtccggaattcccgggtcgacgatttcgtattaaggtattttaagacagaaagagagagaggagagaaaccgcattcataaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttcttcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttggggggggggggattaaataattaaggatccttgagctccacctt

SEQ ID NO: 796 - DNA, 2462 bp, Homo sapiens
  CDS (196)..(1464)
tttgaaatcgatagctgtacgcctgcacgtaccggtccggaattcccgggtcgacccacgcgtccggtgggaaaaaaaggagtgagagaggataaaagaatggaagacagagtaatagggacattacatgaagaccatggataaattatatttttttctctttccgcctctactaacctagcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccgggcttcgatggggatctttcagagatgctggcgtcaaagttagcaagtactggtatcttgagcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacataaaaaaaaaaaa

SEQ ID NO: 797 - DNA, 1111 bp, Homo sapiens
  CDS (43)..(405)
cagaaccctttaggtgacactatagaagagctatgacgtcgcatgcacgcgtacgtaagcttggatcctctagagcagccgcctactactactaaattcgcggccggtcgaccggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacaaaaaaaaaaaaa

SEQ ID NO: 798 - DNA, 5100 bp, Homo sapiens
  CDS (176)..(2359)
cggcaccggtccggaattcccgggtcgacgatttcgtatgagaaggcccaacagcacctttcttgctggtggggaagcctggcctctgggagtggccctgttttccaggatctggcattggagagatgggcaaagatgaagggacgtgccagatcctcagctggggtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagtaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaaaaaaaaaaaaa

SEQ ID NO: 799 - DNA, 2213 bp, Homo sapiens
  CDS (11)..(1465)
  misc_feature (1)...(2213): n = a,t,c or g
attggaagggatgatgtatataactatctattcgatgatgaagataccccaccaaacccaaaaaaagagatctctcgaggatccgaattcgcggccgcgtcgacctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggcaagttctctcgtgctcattttgtgttgctcagcttgctctgaacccacgtgctgcggcactgcggaggagtggaggcagcctatggtgtcaagatgctgtcttcctgggaggagagctaggggaggcctggggcccacttcgtgagagcagccaggggtagtttggagaaggaggtgttgagtcagttgtataaggaggaggttgggngtgactgctgcttattaagatgattcatttcatttccactcgtggttgtgattttcaccttctcaaaactgagtcagcaagagaaaatcttgtcttagaagggccagataacacttcgctgtgagaacaggagggataatggattggagatggctatgtgtaaagcagccctgcctgctgatttaacacactttcaaaatagatgtgtcagtattcatttaaagcaagactctgatgacagaaggaaccttgaaaactacctgatattgaaatggttgtgccctttatagcccttttgcatctccttgactttccagtcatgcctcctaaatcagaagaaaagctgcaaagaaaatgttttgtgtggttctgggcttatttgaataatgttcatgaccacaggctgccatagcacaagtgagaatttcagaccacaagggtttaaggagcagtgctctcttctctcaaagctcagaacggtctctggatccatggtatcgtacacccagtgtggatattaacattctttaatgcaggttatgaataataaataaaacaggtttttgttaataaaaaaaaaaa

SEQ ID NO: 800 - DNA, 2064 bp, Homo sapiens
  CDS (11)..(1774)
attggaagggatgatgtatataactatctattcgatgatgaagataccccaccaaacccaaaaaaagagatctctcgaggatccgaattcgcggccgcgtcgacctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttatcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttttcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaaaaaaaaaaaa

SEQ ID NO: 801 - DNA, 2250 bp, Homo sapiens
  CDS (383)..(1600)
gcacgaggtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaaaaaaaaaaaccacttgactataaatacagatattttcgtcgtgtccctgtacaagaagcagatcagagttttcatgtggggctacagctatgttccagtggtcaccagaggttcaccaaaactcatctggatacatcattcttgtcacattacttacagatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaaaaaaaaaa

SEQ ID NO: 802 - DNA, 1554 bp, Homo sapiens
  CDS (53)..(1489)
ggagggtgggtccctttaaacggcccccccctttttttttttttttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaaaaaaaa

SEQ ID NO: 803 - DNA, 1078 bp, Homo sapiens
  CDS (104)..(1036)
gaggggtacgactcactatagggaaagctggtacgcctgcaggtaccggtccggatttcccgggtcgacgatttcgtgcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagg

SEQ ID NO: 804 - DNA, 1254 bp, Homo sapiens
  CDS (71)..(1144)
cggccccttgaatcattaacctgcaggagccggtccggaattcccgggtcgacccacgcgtccggagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaaaaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtaaggctgttttctagctgtaaacttggctgctgtgttcctcatcaggcttctctgagccactctactgtcttcctaggtacaaggacaatcccttttccttaggggaaagcc

SEQ ID NO: 805 - DNA, 727 bp, Homo sapiens
  CDS (205)..(504)
ctatagggagacccaagctggctagcgtttaaacttaagcttggtaccgagctcggatccactagtccagtgtggtggaattcaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattgaaaaaaaaaaaaa

SEQ ID NO: 806 - DNA, 685 bp, Homo sapiens
  CDS (205)..(462)
ctatagggagacccaagctggctagcgtttaaacttaagcttggtaccgagctcggatccactagtccagtgtggtggaattcaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattgaaaaaaaaaaaaa

SEQ ID NO: 807 - DNA, 1645 bp, Homo sapiens
  CDS (129)..(1106)
atttggccctcgaggccaagaattcggcacgagggcctctgctcgtgggtggttctcgtggaggtcagctcccgcgtgtctccgctcgacagggtgcttgggcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttattaaaaaaaaaaaa

SEQ ID NO: 808 - DNA, 1317 bp, Homo sapiens
  CDS (260)..(934)
ttgttcccgggtcgacgatttcgtgcggcggcggcccgagagctgcgccgggagagctgtgccgcgagcctccgcctcttttttggcaccgcacagtggatccctggaggccgagcgccacgccgcccgggtacccggcagatcgcgaggtggaacgggccgtcgctgcgggggacagcgttccgaggcagttggtcctctccaggatgccgtaggcatcagctgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaa

SEQ ID NO: 809 - DNA, 2165 bp, Homo sapiens
  CDS (1)..(1704)
  misc_feature (1)...(2165): n = a,t,c or g
atgaggactcagccagacatcctggatgaatggcccacctctgacacacaactctctgcagcatctaaagaaattggaagatgcaacacaaaccaaacaatgggccattttgtacattcttcaggattctgtgtgtccatgggggcagcccatggctggcagccccatgaaggcagggccagcatctgtgttgttatcagtacccatcggcaccttgcacacgcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaaggtgtcaaggcgggagtcctggcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtggccgtggctctgtgcagtgttacgttagatagctctcgcctgggtctgtgctgtttgtcgtgaaaagcttaatgggctggccaggctgtgtcaccttctccaagcaaagccatatggagcatctacccagactcccactctgnacacactcactcccacct

SEQ ID NO: 810 - DNA, 1638 bp, Homo sapiens
  CDS (94)..(993)
ccgtacgcatgcagctaccggaccggaattcccgggtcgacgatttcgtgccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccagcagacccgctggctcccagtgtccaaagccagcctcatcttcatcttcaccttgttcatggtgtcctgtaaggtgtttctgacagccacccactcacacagctccccctttgatgccctggagggctacatctgccccgtgctgtttggttcggcctgcgggggtgaccatcaccacgacaaccatggtgggtcccacagcggtggtgggccaggagctcagcattcggccatgcccgccaagtccaaggaggagttgagcgagggctccaggaagaagaaggccaagaaggcggattagggggtggcccaaggggcaccggggagaggacccggacccaggaccctctgagctgggaggcttcctgcgctcagatctatcctttcctggccttgacttccccatctgcaaatcagggtcattggctcaccctccagggctgatgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttctatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaa

SEQ ID NO: 811 - DNA, 1824 bp, Homo sapiens
  CDS (231)..(548)
atttggccctcgaggccaagaattcggcacgagctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgt

SEQ ID NO: 812 - DNA, 1985 bp, Homo sapiens
  CDS (268)..(1281)
cagcagtgctggccggaagaggcgtgaccgtgggggccaacaaggccgggttatcggtttgcggcttttctgtcggaggacgcgaaccggcacgctgcgcctttaaggagtccggctgggctgggcgccggagctgggagccgcgcgggtaggagcccggcgcatggtcccagcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttactaggaaaaag

SEQ ID NO: 813 - DNA, 2580 bp, Homo sapiens
  CDS (141)..(2006)
taatcctaaagtaaactcactaaagggaatatgcttgggacccaacgtgtcgagagccagtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacggcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaaaaaaaaaa

SEQ ID NO: 814 - DNA, 901 bp, Homo sapiens
  CDS (101)..(652)
  misc_feature (1)...(901): n = a,t,c or g
cgcgcctcatagcattacntcagngcggngcaattcgcatctgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaaaaaaaaaaaa

SEQ ID NO: 815 - DNA, 1652 bp, Homo sapiens
  CDS (232)..(975)
ggaattcaggagaacgagttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaaaaaaaaaaaaa

SEQ ID NO: 816 - DNA, 1854 bp, Homo sapiens
  CDS (137)..(928)
  misc_feature (1)...(1854): n = a,t,c or g
atttggccctcgaggccaagaattcggcacgaggctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggctgcagggagaggagcgggacacgcacctttccaggggcctctgtgtcccgcactgtgtgtgagtggaccgcagcggcagccacatgccctggctgccatggggcagaccgcctccacctgccccgcccgtctgggcctgttctgagtgcatttccctgcactgtgtcgtcactgcacagccagtcaccgcggtctcagtcaatcngcgcggatggctatgcttggggttccagggtnggccccaagagttcagggtcatcttggggagccctgggggtggaatgacaaaccgcattgtcccgttgcccgccattggaagaagcgaagttttgtattgggagtgg

SEQ ID NO: 817 - DNA, 1007 bp, Homo sapiens
  CDS (90)..(581)
cactagtagctggtgctccaggctggcggcgctcacctttctcctagccgggtgacccaggggatttattttatgtggctttctctgaaatgccaaagccacccgattattcagagctgagtgactctttaacgcttgccgtgggaacaggaagattttcgggaccattgcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaaaaaaaaaaaaa

SEQ ID NO: 818 - DNA, 1317 bp, Homo sapiens
  CDS (446)..(931)
tgtgattccccttgaattgaacgcctgcggtaccggtccggaattcccgggtcgacccacgcgtccgcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaaaaattaaccccgccccaagttttaaaagttttaaaaaa

SEQ ID NO: 819 - DNA, 913 bp, Homo sapiens
  CDS (174)..(680)
  misc_feature (1)...(913): n = a,t,c or g
cccccccccccccgncccccnnaattgaccgccnttaatagaccgctctgcaggaattcggcacgagcggtccccccctctccctccgcttcgcactcccgtcgggtacgggaaggttcaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttccctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaaaaaaaaaaaa

SEQ ID NO: 820 - DNA, 1767 bp, Homo sapiens
  CDS (153)..(1223)
  misc_feature (1)...(1767): n = a,t,c or g
ggaaatgtaaanaanccttgatgtcctcgacgagcggtcaccgagccgcaattcccgggtcgacgatttcgagcccgcgctgtccctgacgcggatcactggcccctcttgagcacttccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcagaggctggcgctcttccgtgtactgtgtgttcatcttcaggagggagggaaccccttccccagaggcctcctccccatccttcactcctcactcaaccacaaggcttcacgtgaagctggggttccattttctcggacgcgtgggtcgacccgggaattccggaccggtacctgaggcgtcaaacctc

SEQ ID NO: 821 - DNA, 1559 bp, Homo sapiens
  CDS (132)..(1214)
gtaccggtccggaattcccggagtcgacgatttcgttcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcaaaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaaatattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggagg

SEQ ID NO: 822 - DNA, 1412 bp, Homo sapiens
  CDS (132)..(1067)
gtaccggtccggaattcccggagtcgacgatttcgttcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaaggttaaaaggacaactctggtggatagcaaaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaaatattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggagg

SEQ ID NO: 823 - DNA, 6572 bp, Homo sapiens
  CDS (521)..(2611)
taagcttgcggccgcatattgttttttttttttttttttttttcccacagcaactgccaatgaaggatgaatcccctttttaaaaagttgttgttgttgttgtttatttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgatttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaaaaaaaaaaaa

SEQ ID NO: 824 - DNA, 2727 bp, Homo sapiens
  CDS (569)..(1147)
gtattgtccccagtatcagaaccggaagaagaaaatgatcctgatggtccctgtgctttcagaaggcgggcaggatgccagtattatgctcctcgtttggaccaagctaaccattcatgtgaaaatccagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaagaactataggaagctcatctgtgggctctattgggtttcagataatccaatataaactacctttgatatgaaagttcgtaagatattttacagaatgtaagtaatttgcagtatcgcagtcattgaaatgtcataagtgagcctcattttataaataaaagtttagagtagaattatattgcaagggggttttgtcaagtaagtactgggaaatgtaaatatttttaatgaatacaattaaaaccatttcaaacttaaaaaaaaaaaaa

SEQ ID NO: 825 - DNA, 2330 bp, Homo sapiens
  CDS (142)..(1413)
ttctgttccggaattcccgggtcgacccacgcgtccggagctgtcgcgggcggcgcccgtccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccacgctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaaaaaaaaaaaaaa

SEQ ID NO: 826 - DNA, 2171 bp, Homo sapiens
  CDS (142)..(1254)
ttctgttccggaattcccgggtcgacccacgcgtccggagctgtcgcgggcggcgcccgtccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaagggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccacgctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaaaaaaaaaaaaaa

SEQ ID NO: 827 - DNA, 1958 bp, Homo sapiens
  CDS (512)..(754)
acgcctgcaggtaccggtccggaattcccgggtcgacgatttcgtcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaagttgcctcctggttataaagcaaagccaaactggagagaccagagccagagcctttattactaaaagataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaaaaaaaaaaaaa

SEQ ID NO: 828 - DNA, 1102 bp, Homo sapiens
  CDS (234)..(875)
ggtcgacctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaaaagggcctgttgcatcagcctttgaccttggccagcaccacctgcccccactggctttttggtgccccttgtccccacttcagccccaggacctttccttgccctttggttccagaaatcagactgttccctgttcacagcaccctcagggttttaaggttttcatgccctatcacaaatacctcttttatctgtccccccctcccagactaggaccctcaaataaagctgttttttttccaaaaaaaaaaa

SEQ ID NO: 829 - DNA, 2710 bp, Homo sapiens
  CDS (242)..(2560)
gcacgagggggttagttccgacaccttcacagttgaagagcaggcagaaggagttgtgaagacaggacaatcttcttggggatgctggtcctggaagccagcgggccttgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattcgagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcgtttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaaaaaaaaaaa

SEQ ID NO: 830 - DNA, 2433 bp, Homo sapiens
  CDS (203)..(2062)
gtccggaattcccgggtcgacgatttcgtgctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgaaaaaaaaa

SEQ ID NO: 831 - DNA, 1477 bp, Homo sapiens
  CDS (231)..(1187)
cattgtataggagacccagctggctagcgtttaaacttaagcttggtaccgagctcggatccactagtccagtgtggtggaattcccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagagtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaaaaaaaaaaaa

SEQ ID NO: 832 - DNA, 1082 bp, Homo sapiens
  CDS (40)..(603)
ccggaattcccgggtcgacccacgcgtccgctggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaaaaa

SEQ ID NO: 833 - DNA, 1974 bp, Homo sapiens
  CDS (304)..(1677)
gcactgacgtaccggtccggaattcccgggtcgacgatttcgtgcggaagggtgagcttgtcgttttgctcctaggcgttggggcctgaattctcccagggttggggtgctgggcgagagtcccggtggggaacgtgagatcagcgggggcgtggactgatctgaaagggcagagtggagtcgcattgtgagggggtgggcaagcggtctgcgaagcctcggcccgcagggtacatctgaaggatccttaattaaattaatccccccccccccccaaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaa

SEQ ID NO: 834 - DNA, 2025 bp, Homo sapiens
  CDS (304)..(1728)
gcactgacgtaccggtccggaattcccgggtcgacgatttcgtgcggaagggtgagcttgtcgttttgctcctaggcgttggggcctgaattctcccagggttggggtgctgggcgagagtcccggtggggaacgtgagatcagcgggggcgtggactgatctgaaagggcagagtggagtcgcattgtgagggggtgggcaagcggtctgcgaagcctcggcccgcagggtacatctgaaggatccttaattaaattaatccccccccccccccaaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaa

SEQ ID NO: 835 - DNA, 2483 bp, Homo sapiens
  CDS (494)..(1192)
gaattcggcacgagggcagtgggggttacagacagcaccagaggcactcagggcaggagggtagtgggtgctggtcaaggccgctttgcaggggattgggagtggatgctagtggcagtaaagggtaaagggagggcagtgggctctgagctaggaggaggtggcccagccacttctgcagagttcctaaccccagacagctctactgcaccaccccagcccttccccacagcccaaaggaacttaagagggagagcactgcgggcatgcagccaggatttccagcattgcttccaggctcctaggggaaacttaggcactagcgcagactacatccagacatggctatagggaaaagtttgccttgtggcacactgggtgtgtctctctatcctctctcctcccccagcaggcatgaagacccccaacgcacaggaagccgaaggggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatgacatgctgtctgtaagccctttgtcttgttgaaaagttcgggtgtgtttggtagatggggcatggaaggaacgaacagctgtcaatttcggctgtgaataaagttcagctagaatcataatcagtcatttaaaaatggcactggatttagctggtctggtctggagggggcaggggaaggaacaagagattggctgtcttggggagagaggaggaggtgactgcttaggaagaggtggaaaagggccagaaagggaggggctccttgggggaggggatgacctatgagaaggaaacatccaactcagaaggaagactaacagagggagagtgagatcttggggcttagaggaaaatagaataaactgagtagagaggaacacaaagaagcttagaagagggtccagagtaaggtggagaaggatcaacctgacagggatctgggagaggctaaaggatacacaaaggaagaggctatgtgggttagggtgttggagggattagaagagggccactgaggaaggaggaattcaaagaagaaagactgacagagggagtgagaatacaggaaaagagttgtggggtatggggcccatgagagatcggaaggcccaggaaaatgttggacttctggtagtgtccacattgctcttcctggctctatgcacaaaggaagtggcaactgtcaaagatgccagatgcattggaggttcactagaagagcatgttgacaggaatgactcagtcaagttaatcaggagccaagtttatgcccataaggcttttcctgtttcagggagttaatgacacacttgtccagcagaaacccaatgctcagcctaaacacgctaacatggtgccccacatgtgctgggctgtgggctgcctcctcacatttgtcctgcgctagataagcaatcttggtagaggatgggttagtggggctctcagaacttaagagatgtgccatcttgcatttggaaagtactttatccagaaaaaatgaaatcttactgaactcaggtacagcagtctcatcactcctattccttctgctggaatgtttgttttctatctagagatgaggggcatcagaggactgagcctagtgtttctctcgag

SEQ ID NO: 836 - DNA, 2288 bp, Homo sapiens
  CDS (221)..(997)
atttggccctcgaggccaagaattcggcacgagcacagcccaaaggaacttaagagggagagcactgggggcatgcagccaggatttccagcattgcttccaggctcctaggggaaacttaggcactagcgcagactacatccagacatggctatagggaaaagtttgccttgtggcacactgggtatgcctctctatcctctctcctcccccagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatgacatgctgtctgtaagccctttgtcttgttgaaaagttcgggtgtgtttggtagatggggcatggaaggaacgaacagctgtcaatttcggctgtgaataaagttcagctagaatcataatcagtcatttaaaaatggcactggatttagctggtctggtctggagggggcaggggaaggaacaagagattggctgtcttggggagagaggaggaggtgactgcttaggaagaggtggaaaagggccagaaagggaggggctccttgggggaggggatgacctatgagaaggaaacatccaactcagaaggaagactaacagagggagagtgagatcttggggcttagaggaaaatagaataaactgagtagagaggaacacaaagaagcttagaagagggtccagagtaaggtggagaaggatcaacctgacagggatctgggagaggctaaaggatacacaaaggaagaggctatgtgggttagggtgttggagggattagaagagggccactgaggaaggaggaattcaaagaagaaagactgacagagggagtgagaatacaggaaaagagttgtggggtatggggcccatgagagatcggaaggcccaggaaaatgttggacttctggtagtgtccacattgctcttcctggctctatgcacaaaggaagtggcaactgtcaaagatgccagatgcattggaggttcactagaagagcatgttgacaggaatgactcagtcaagttaatcaggagccaagtttatgcccataaggcttttcctgtttcagggagttaatgacacacttgtccagcagaaacccaatgctcagcctaaacacgctaacatggtgccccacatgtgctgggctgtgggctgcctcctcacatttgtcctgcgctagataagcaatcttggtagaggatgggttagtggggctctcagaacttaagagatgtgccatcttgcatttggaaagtactttatccagaaaaaatgaaatcttactgaactcaggtacagcagtctcatcactcctattccttctgctggaatgtttgttttctatctagagatgaggggcatcagaggactgagcctagtgtttctctcgag

SEQ ID NO: 837 - DNA, 1989 bp, Homo sapiens
  CDS (115)..(1374)
attgattaccctgcggtaccggcccggaattcccgggtcgacccacgcgtccgggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtagaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaaaaaaaaa

SEQ ID NO: 838 - DNA, 1979 bp, Homo sapiens
  CDS (175)..(1053)
tatcacgactcactatagggaatttggccctcgaggccaagaattcggcacgaggtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaaaaaaaaaaaaaa

SEQ ID NO: 839 - DNA, 923 bp, Homo sapiens
  CDS (180)..(587)
gcgacacccatcgaacgcctgtggtaccggtccggaattcccgggtcgacccacgcgtccggccctgggaagcccgcaagaggcctcagcggaggccgtccgagcgccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggctgtgaaaaaaaaaaaa

SEQ ID NO: 840 - DNA, 4758 bp, Homo sapiens
  CDS (194)..(1144)
aaggatccttaattaaattaatccccccccccccctctcctccccccgcgccgatggtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgccgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcctagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggcttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccagctgccacacccccgacactcctgctgtccactggccttagctcctgcaagttccccagtgtccgcacctgttcccttccctgacctcaccttcctggggtctgtgactgactggagataaaaataaaagcaattgtgacaaaaaaaaaaaa

SEQ ID NO: 841 - DNA, 1769 bp, Homo sapiens
  CDS (211)..(1272)
ctcgaatttcattcctggaaatccagtgtctatgaacccaacatacatggcgttgcatcacagttggagtcagatgtggcaccggagggcaggtgtctggcttgtccagccggaacgcctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcaggtaatggacactgtcgctaacagctcacactctgacgggcctcacagtatcagccacagggtccgggacctggtgactcatcacagtggctgtgggaggcaggggcctggctgttatggaccctggagccaggatccccccacggcctgcgggcctaagagcccaaaagcagacaggggggctggggaccctctcggggaccctctcgtcggcatcctcaagggcgccagccagtggggctgcagtggggatggcgccaggtggcggccgttcggctctctggggaggcgaccctcagctcagtgcaagaatccaggctctgaagcccgcaggccgtggggggatcctggctccagggtccataacagccaggcccctgcctcccacagccactgtgatgagtcaccaggtcccggaccctgtggctgatactgtgaggaccgtcagagtgtgagctgttagcgacagtgtccacggacgcgtgggtcgacccgggaattccgggcgggtattccag

SEQ ID NO: 842 - DNA, 2735 bp, Homo sapiens
  CDS (334)..(1314)
atgcgctaccggtccggaattcccgggtcgacgatttcgtggaagagggggagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaaaaaaaaa

SEQ ID NO: 843 - DNA, 1765 bp, Homo sapiens
  CDS (411)..(686)
ggaattcccgggtcgacgatttcgtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaaggctataggagaaatttctcccttctgaatgtgtccaactaactctgttcacctgagaaatcatattccccagctctgggtatccctgaataaccacaggagaacagttccaggccctgataagtcagctattgcaagggggacctggctggaagatatgaaggaaaaatatcattcttgaactaataagttgagagatcacagccttcaggggaccagaagggaaggctgaacagagaagggcaatttcacgttcgccatgtccatatttctatcgtcatgagccatctcaccttacaggcagggaagttttgagcttagagaatgggatgcgtcaagaaaaccgtggctcccccagctctgttcctggattcagtgcctgttgtttcatcctgtgtagactggagtcagggtctacacagttggaattctatggaaccaagatgctgtgtggcagatggatgtggactccaactgtgacaatccagaaggccttggggacttgtttcatgaacagctccctgtaggatctctgttggggtgggggattctaggggcatctccgcagttttcttctgaaaacaaaacgaatacaagttgggcaggtgcaacaactgtgcatgcagtcccctcccagggctggctagcagtattgttgggtaccgtaagcacttagcattgttaagtgagcataagtaacaagatgcaacagcctctggccaagttttgaagattttgttttaaagtatgcttttagatgttgacattcatgattattaaaaggaacaaaactcaatttggggtctcaagagccacaattctagacttctaggatgtcaggagccatgctcttaagcttctcaccctgctgttttaatgagattaatgattattttccactgagcacctacctgtgatgttcataaaaaagtgaaataaatgactcacatggagatttggaaggatatcactgtggaaagtagatgttaacagcctctagaaatatgataattatcagctatttgagatgcagtcactgtaatgtgataacaagatgtgttgtgcaggtagaaagcatggagagaaatggcacaaagtagagttataagaaaaaaaaaaaa

SEQ ID NO: 844 - DNA, 3063 bp, Homo sapiens
  CDS (1)..(3063)
atggtggagctgggctgttgtctgcttccagaactggctttttctgctgctctggaggtaggcacaggttttacccctctttctggagcccgtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaattgattggtccccagccagaagcagtgaagcttctcatgacagccctggggatgagatgggtagatgggagctgggtagcagcacagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagttaacagtggttctgacggtgagtgcagtgccaatgatggagatggtggtggtgctggtgttgaccataagatggcagttatggtggtggtagtggtgacactgttggtgatgatgacttatgatgggtgggatgtctgtgtggtcacagagtacctgtgggagggcaattctgaccccaaggtaggaagcagtgatccggtaattccaggcaccaaggcagataaaaagaccaagatggggcccatgagtgaggaggacaagagagaaaggagaagtttgggtgtaaatcccagagattgttcatcattggatgacagttctccatcagggtctgcagtcctctaccctggacttgctgcatcctggagcccccagcagtcaggtaccggctctcagaactgcctgcatcccattggcctgagctgctgtctgccagggctgctggcaggacttatcagtccctgctcttccgaccccacaaagctcagttactgcgtcattgctacttaccagggggagaaacaacgacttagcacagcatccgggccccaggggagagtgttcccccctcaaaagctgctgccattggagatgcaggagaggaagccaagtgggcccaggagggaccggatgattcgggactctatgctggatgtgaagacccagaaatgtttcagaattagactctttctcctcaacgacccacagtctcgggagagaagacagattcttcatcaagtcagagagctcaggggtcctgaaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagatggcaagctatgcagtagaaatttcgtgactgtggagtcttattctcactgggctctgaccctgattcctgaggcttccaagggttctctggagctggatgagcaagatgtctgcagtgaagggacagaggaattgaggccaagctactggggaggggtggaaatgccattctggaggatctgtgacgttgacagagactttatcgacacaacaagccagctaacccctaacgaacgtgttgattcattcattcattccatcagttactccaacatgtgggactgcatggttgtgaaaacagaatatgaccttgtaaaaggagaagccttgggcccttga

SEQ ID NO: 845 - DNA, 922 bp, Homo sapiens
  CDS (96)..(740)
cggccccaggtatagcagactcagctggctagcgtttaaacttaagcttggtaccgagctcggatccactagtccagtgtggtggaattccggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggagcgaaacccttcttggcaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctccaaaaaaaaaaaa

SEQ ID NO: 846 - DNA, 1470 bp, Homo sapiens
  CDS (248)..(1174)
aaggatccttaattaaattaacccccccccccccccccccgagagcggtggcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggtttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaaaa

SEQ ID NO: 847 - DNA, 1751 bp, Homo sapiens
  CDS (210)..(1253)
cgcctgcacgtaccggtccggaattcccgggtcgacgatttcgtcgcctccgctatctgggtcaggacgcgacggccgcggcgcgggaccttaggacccgcgggctccagggctactgtccgtccgccactgcccgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctacttctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaaaaaaaaaaaa

SEQ ID NO: 848 - DNA, 2351 bp, Homo sapiens
  CDS (46)..(1422)
  misc_feature (1)...(2351): n = a,t,c or g
taagcttgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtaagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatgctttagcccaggaggttgaggctcctgtgaaccctgatggcaccactgcactccagcctgggtngacagggtgagaccctgtctcaaaaaaaaaaaa

SEQ ID NO: 849 - DNA, 1281 bp, Homo sapiens
  CDS (416)..(1033)
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgtccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaataaaaaaaaaaa

SEQ ID NO: 850 - DNA, 2887 bp, Homo sapiens
  CDS (20)..(2887)
gcacgagcaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagcaaatgataaaaccaggagctttgacgatttttcgccagatcaagcggctgcagaatgtttgagcattagaaaaaggcgaattcttaagggttcttgtcagacaggttacctccgaaaagccttattttcagatacagtcacattgggcattaaggcttcaacatatggattttggggaggcatgattcagtccatagtgaagggcttggcagagaccttcaacttctggatacatatttgggaactgaatgacttgcagtatatttcagccctttttgcctgctcagaagagatgcccgattatcatttagaaaaacaattggctgataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaa

SEQ ID NO: 851 - DNA, 2560 bp, Homo sapiens
  CDS (20)..(2560)
gcacgagcaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaa

SEQ ID NO: 852 - DNA, 2198 bp, Homo sapiens
  CDS (206)..(1867)
gtaccccccccggaattcccgggtcgacgatttcgtctagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacaagtcctttttctctgcctcacccctgtattgcggccgctctagaggatccaagcttacgtacgcgtgcatacgacatg

SEQ ID NO: 853 - DNA, 1067 bp, Homo sapiens
  CDS (151)..(984)
aactgattaccctttgcgcctgcaggtaccggtccggaattcccgggtcgacccacgcgtccgaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttatcccgggcccgcagcggcctaaagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggctcccccccaaccaagcggcagcggcggagtcggggccggcccagtggtggtgccagacggcggcggagaggggccccagccgcaccccagcagcagtcagagcccgccagaccttcctctgaaggcaaagtgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaagaaggtggctgtttactggttttggccccatgttctagatcgcgagcggccgctctagaggatccaagcttacgtacgcgtgcatgcgacgtcatagctcttctatagtgtcacctaaatt

SEQ ID NO: 854 - DNA, 1146 bp, Homo sapiens
  CDS (109)..(1122)
tgattacgccaagcttggcacgaggcctcgtgccagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggaaatcatgaaaatcggcactccgatttaacaggaaagagttgcaagacatccgagaacagatttcttgaagaaaatgcacccttggttatgtatggcatcactcaccatctgttcatggatacttctacatgcaaagttgtacatgacttggaataaaccagctctagttttatcatcaaa

SEQ ID NO: 855 - DNA, 914 bp, Homo sapiens
  CDS (109)..(867)
tgattacgccaagcttggcacgaggcctcgtgccagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgacatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccgggtaaggccccttccttggtaacctatcagcttggaaatgaatgtcactgggatctgaaaaaaaaaaaa

SEQ ID NO: 856 - DNA, 3181 bp, Homo sapiens
  CDS (254)..(2245)
cgaattccaggtcgacacacgcgtccgtgctttgtcagccctgattgagcccaagaaagccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctggcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataattatttctgtgattttacttctatgtataagaaagacaatgaatagcagatcttacatctttatcaatagggggtctgtaaaaattgaattaaattaggaagagggaaaaagagttagttattaaagaaaatgaagatttcctacccttacttaaaaagcatcatttctgaataaaagtagatttgtttacttttaaaaaaaaaaa

SEQ ID NO: 857 - DNA, 4223 bp, Homo sapiens
  CDS (188)..(2035)
ctcagggagggcaggagagcctgaggagtggcggggccgccagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccatggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaagggttcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaaaatg

SEQ ID NO: 858 - DNA, 1675 bp, Homo sapiens
  CDS (292)..(1344)
tacatctagggatctgaaattacctggtttagttagatacatagaaatttttcaaattacataattctacatggtacaatgtttatttcatctatttatgttaatttggtttattaaacttttatatatttatatttagagattctaaaaattgcatgatgtttgatattattactactttatattgcagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgca

SEQ ID NO: 859 - DNA, 1716 bp, Homo sapiens
  CDS (49)..(1074)
ctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccagggggccggcacctgcaatgctcaggagcccagctcgcacctggagagcacctcagatcccaggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtcaaaaaaaaaaa

SEQ ID NO: 860 - DNA, 2332 bp, Homo sapiens
  CDS (427)..(2238)
attcccgggtcgacccacgcgtccgattttatctttggaaaaaaagataaaatggatccaaatagatccactttcttgttaattacttttcgttactgttgcggttttctgagaactagcctaattgtttctgtttctctttatcatcatcaaacattgcagctacgactacctgtcatttatcccgctctcggatatcatgtgatatttgtctgtgtcttctttttaaaaacactgtcgtcatatttgtggtctaatacttgttttcttcccccctaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaaaaaaaaaa

SEQ ID NO: 861 - DNA, 4494 bp, Homo sapiens
  CDS (207)..(3002)
attcccgggtcgacgatttcgtactgcggattcaggagggaatgaagccggggggcccagctcctgtgagccgcagctgtgtctctccatctcctgggtcctatgagctgcggctgcttctctccatctcctgggtcctgtgaggcgcagcccatcatggggccattgttcaggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggcggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgtgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagcttatcaggcgcagggccccagacagcttcccagccggccctagagcccggcctgggccaatgatggagggcggccaccagcccagggcctgcccatccagaagggactccccagggcctgggggaggagacccttggaaaagtcctctcttcccagctcctgattctggatctgagattctcagatcacaggcccctgtgctccaggccgaggctgggccaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaaaaaaaaaaaaaaaaaaaaaaaaaaaaaaaaaaaaaaatgagcggcc

SEQ ID NO: 862 - DNA, 1902 bp, Homo sapiens
  CDS (986)..(1426)
ttatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaaaaaaaaaaaaaaaaaaaaaaaaaaaaaaaaaaagaaaaaaaaattcctggggccgaaagttaattcctttagttagggttattttagtctggaatgggcctgtttttatg

SEQ ID NO: 863 - DNA, 3588 bp, Homo sapiens
  CDS (11)..(2806)
ccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccggcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtgggaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggttgccagtctggcatgcagctacccaggcccacccatcacgtgtgatttacatgtaggtaccctgccagggcctatgcc

SEQ ID NO: 864 - DNA, 1795 bp, Homo sapiens
  CDS (164)..(1429)
ctcgacgatttcgtggctcgcgcgggtggagccgcctcggcgttcgagcggggtgggggctgcccggttgagatttcccggcgggtcccggcctctgcgtgcacgcgcctgcgtgctcgcgctcgcggttctggcgctgctggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaaaaaaaaaaa

SEQ ID NO: 865 - DNA, 769 bp, Homo sapiens
  CDS (239)..(625)
accggtccggaattcccgggtcgacgatttcgtctttccagacaaagacaagtgacaagaattttaggtttaaaaagcaaccagattcatctcagcagcttttgtagttttaaataagcaaggagtttctccagcgaaacttcctcacacctcttggtcttggtctcttcagacactttccttcctgttctctggagatcttgcagaaaagagcctgcagtgtttcccttgctcagccatgctcctggagcttatcccactgctggggatacattttgtcctgagaactgccagagcccagtcagtgacccagcctgacatccacatcactgtctctgaaggagcctcactggagttgagatgtaactattcctatggggcaacaccttatctcttctggatggaaagaactgttgaagaagcttttatacttcttgtttgcttgaagccttggagggtagcaagtagtctggagaaaaaggagaaggaggatgaatctttccagctgctacttggctcacgctataatgtattaaaggcacactgtcttctacctttgataagatggctaacttcaggtgactcactgttatcagctcagccacattgcccacagggactgtgatgggcactttatgcgaatcttaaaggaggttcctgcagcatgagaggcttctccagcgtccggctcctgcagtgcacccacaccaggttcctgcgctgtacagtggccagcagtgtcctccagcacttccatttttgcgtggta

SEQ ID NO: 866 - DNA, 1024 bp, Homo sapiens
  CDS (519)..(980)
ccggaattcccgggtcgacccacgcgtccggggcccgggcggccggccagccgtctcgccttgtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactg

SEQ ID NO: 867 - DNA, 1326 bp, Homo sapiens
  CDS (307)..(1068)
gtacgcctgcaggtaccggtccggaattcccgggtcgacccacgcgtccgctcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcatttttagtattgcatatagtcctgatgggaaatacctagccagtggagccatagatggaatcatcaatatttttgatattgcaactggaaaacttctgcataccctggaaggccatgccctgcccattcgctccttgaccttttccccggactcccagctccttgtcactgcttcagatgatggctacatcaagatctatgatgtgtgtcgcttcttgctgctctcaagccctactccccatgcttctgcttctagcttgctgggagctgggaaactgaccaagcatggaaaactacagcaatgctcataacaggctaaaaggctctggggaagaaggcatttcaacagcagaaaagaggaagaagagggagaagagaaaatggagaaacaagaaataagccaacacaaaagaggggtgaagaaaagagagggtgcaaaagagaacaaagtaaaaacaaaaacaaaacaaaaaggacaaacaaatccccaaagaactctccaacggcaggtttcctggatgctccacccttccttataataaagaaggaaatggaaaaaaaaaaaaaaa

SEQ ID NO: 868 - DNA, 1292 bp, Homo sapiens
  CDS (370)..(1089)
gcctgcacgtaccggtccggaattcccgggtcgacccacgcgtccgctgggagtgagagctcctgggactttctgtttccagggcaggggctgggatgatggcgcgggagaggctgtgtcctcgcgtgtcacccaccagccctcgagcagaggcaggcttggagtctgcagccaccctgggaatgtctgtgcttcctcgtggagctgacatgatggtgaaataggttcaatcctccacctacccagggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctgcagaggcctggccctgggcaaacagccgccatcagggttcacctcggtgggggaccccactcacccccttagggtcgccacccctcacggcaacttgtgcctggcgtcaataaagacctggaaggatgttgtgaaaaaaaaaaaaaaaa

SEQ ID NO: 869 - DNA, 2532 bp, Homo sapiens
  CDS (1)..(2532)
atggaaaggacagcagaggctctggctgctaaagagaaagtgaaaatggagaatcataaagggagggaacgacagatggaggtggcctcagatttcttgcgacaaggaaaccggcagtcttccgcttccggttgctctgttgccatagtaaccgcacccataacagccgtggtggttatggctggcctgagcggcgcgcagatccccgacggggagttcaccgcggtcgtgtaccgcctcatccgcaatgcacgctacgccgaggcggtgcagctgctgggcggagaactgcagcggagccctaggagccgcgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatgcggaggccacccgggtcgccttccttctcctggataaccccgcctaccacagccgggtcctccgcctgcaagctgctatcaagtacagcgagggcgatctgccagggtccaggagcctggtagagcagctgccgagtagggaagggggagaggaaagtgggggcgagaatgagaccgatggccagatcaacctgggttgtttgctctacaaggagggacagtatgaagctgcatgctccaagttttttgccgccctgcaggcctcgggctaccagcctgacctttcctacaacctggctttggcctattacagcagccgacagtatgcttcagcactgaagcatatcgctgagattattgagcgtggcatccgccagcaccctgagctaggtgtgggcatgaccactgagggcattgatgttcgcagtgttggcaacaccttagtcctccatcagactgctctggtggaagccttcaaccttaaggcagctatagaataccaactgagaaactatgaggcagctcaagaagccctcactgacatgccacccagggcagaggaagagttggaccctgtgaccctacacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgatttataagttcctcacaccctatctctatgacttcttggacgctgtgatcacttgccagacagctcctgaagaggctttcattaagcttgatgggctagcagggatgctgactgagcagcttcggagactcaccaagcaagtacaggaagcaagacacaacagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccagataagaaaatgtaccatctctgcattgtgaatttggtgataggaactctttattgtgccaaaggaaattatgactttggtatttctcgagttatcaaaagcttggaaccttacaacaaaaagctgggaacagacacctggtattatgccaaaagatgcttcctgtccttgttagaaaacatgtcaaaacacacaatcatgcttcgtgatagtgtaattcacgaatgtgtccagtttctagaacactgtgaacttcatggcagaaacatacctgctgttattgaacaacccctggaagaagaaagaatgcatgcagcggacagatccagctgtggcagtttctgctggagctgctggctgaccgcgcgaacgcggctgcatcgcgtgggagggcggtcacggcgagttcaagctcacggacccggacgaggtggcgcggcggtggggcgagcgcaagagcaagcccaacatgaactacgacaagctgagccgcgccctgctatctactacgacaagaacatcatgagcaaggtgcatggtaagcgctacgcctaccgcttcgacttccagggcctggcgcaggacggcgcgctctacaagctgcccgccggcctcgacccgctgcccttccccggcctctccaaactcaacctcatggccgcctcgctggaggtcgcgccgacggcttctcctactggccgggccggtgccgacgccaccgctgaagccgccagcgccgcgctctaa

SEQ ID NO: 870 - DNA, 1981 bp, Homo sapiens
  CDS (413)..(1165)
aacaatagtccttacactgaattcatttatcctgaaatggcagacatcattcatttttcttgaaatggcagaatagcagctgcagacattaatctatggtacataccaagcaattcaactttttcttgtaatgtcagacttttctcttcttcttgggagcacttccagtatcactagtgctagtggcatcactttatacgagtcttatggtattattcaaagtttacagtattgcattaaacacgatgaaaaatacatgagaaccacaagagattaccttttactgtggtaggcaatttactacagagacaaactgctgaaacagaggtgatcagtgccgattaaaatgtgtggcattttaagtggatacttgcagcacctgaactcactgcaatagcaataggaggtggctatgaaattattagagaagtatagtatataccacagtaactttttgccactctcacttaatactgcatctttacatttgtttcctcgtgccgaattcggcacgaggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaaaaaaaaaaaaa

SEQ ID NO: 871 - DNA, 1368 bp, Homo sapiens
  CDS (103)..(447)
atgggctaacattgactgatcctgtggtaccggtccggaattcccgggtcgacccacgcgtccgggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccagggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcgcaatcagcttctatccttgacttagattctggtggagagaagtgagaataggcagcccccaaataaaaaatattcatgg

SEQ ID NO: 872 - DNA, 1403 bp, Homo sapiens
  CDS (317)..(994)
agttggacgaggaaatgaatgaaatgaagtaatacttgtatatacctaaaagcctaaaagaagcttaaagtaactccacactctggtgtgtttccttctggtctgtttttgcctctgatagtattaataggattatataatgtatcctttcaaaaatatatagttttattttgttttcctcccaattaacattgtatcatgctttctcatatcatatgcttctttgaaacatgaacttagagtggcaaggtgttctctgagatggacattctgctgttttctctttacagtttcagaagaggagccccgccgaggcatgagggccgtgctccccccagaggaagggatggttttcctggtcctgaaggactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaaaaaaaaaaaaa

SEQ ID NO: 873 - DNA, 3860 bp, Homo sapiens
  CDS (147)..(3860)
atagaaaagctgtgacgcctgcacgtaccggtccggaattcccgggtcgacgatttcgtgtcgcgccctcgagggagccagctgggccatggccgcgaggcaggggtgagaccggcggccacccgggagccctccgcacccgcaccatgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgaccgtgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagcattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactcaaaattgaacctcgactccctgcttaa

SEQ ID NO: 874 - DNA, 2003 bp, Homo sapiens
  CDS (194)..(1057)
tcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgtgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccatcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgccaaaaaaaaaaaa

SEQ ID NO: 875 - DNA, 713 bp, Homo sapiens
  CDS (130)..(639)
ctctgccctggccagtggggagtactcctgaaacctcaggtggccctgacctgagtgacagcctctcctcagggggtgttgtgacccagcccctgcttcataaggtcaaggttggatggccagccgtggatggcagggctggaggcttggctttcacagaacttctccctccaccaacctcagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggcgccacaccgtgaagctcacctgggtgagtggaaacagaaagagtgcccttagaagtataatactggagagtgccactcttatcaacgctttacgaataccccccgactgaggggggaatacacacc

SEQ ID NO: 876 - DNA, 783 bp, Homo sapiens
  CDS (260)..(610)
gacgtcgcatgcacgcgtacgtaagcttggatcctctagagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctttggggtctcctctaaagcccccgaggcagacccactcaagaacaaagctctcgagacacaatgttacaccgtgggactcagctgaccctgcctcaccctccacactccttgcgacctcatgagccatgcgcagggtggttgttctgttcaaataaagggacgtgttttccacactgaaaaaaaaaaaa

SEQ ID NO: 877 - DNA, 2105 bp, Homo sapiens
  CDS (360)..(1742)
aagctggtacgcctgcaggtaccggtccggtattcccgggtcgacgatttcgtggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtggtcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactgcaaaaaaaaaaaaaaa

SEQ ID NO: 878 - DNA, 1057 bp, Homo sapiens
  CDS (440)..(937)
gcccgcatatccgagccccgcccggccccctccgtgggcccgcctgccccacgcgcggcggggccggccccgtccccccgcgccccgaaccggggccgcgcccgacccgctcgctcccgagccgtaccgggcccgccgggtgccctcccggccccgcctgccccgacccggggggcgcccgttccgcgccccgccgccgccggcgcgtagcgaacgcggggccgtgtggcggcccgagccgtagcgagtgcgatcgcgggcctggggtctggcgcgcgcccgcggggctcgcgcacacgcggcccctggaggacgagcgggcgaacgggctgtgagccccacccccagctcccatccaatcaccgtccctccctccgggggctgggcggacgggctgcactccaagcagctagctcctgcactaggctctcagccagggatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgtaaaaaaaaaaaa

SEQ ID NO: 879 - DNA, 1857 bp, Homo sapiens
  CDS (58)..(330)
ccggaattcccgggtcgacaccacgcgtccgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcaagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccatgaaacaagtacacaggatgtgatcaacaaagttctattttacaggagtatgatcctgtcgataccttgccgtagttatgtaacatgattggagcgcaaccagctgttctcttgaccacagatcgagagtgaggggtattttgtgacattacacagcatcaggagcctggtgcctcatcaggtgtaagttcttataaccactcttggcaaatttattaaagacaggaacacagtca

SEQ ID NO: 880 - DNA, 1405 bp, Homo sapiens
  CDS (366)..(1289)
atgcgtacgttagcttggatcctctagagcggccgggtgtgagtgtgtgggagtgagagtgtgtgggagtggggtgagggagaagctgacgggacgcgaggcggtgagaaactgggcgagtgtgcgaggacgcccggccagcctgcgggagccgcagtcggcggaggagaaaggaggcggctcccggtatcccgaccccctccccctcctcttcttcccccacttccagccgcccggcggcccgcgctttctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatccttttcaggagccaaaaaaacaaatacaaacaaacaaaaaaatacccagagaaaaaactttccttcttcccccttcctgatgatgagtgagaagtattgagaactttcggggtcagtgcccttcctaactccccttccccaataatgcagctgtataatgaatgggtaatgcaccggtttggattcaggcacagcc

SEQ ID NO: 881 - DNA, 2412 bp, Homo sapiens
  CDS (67)..(1395)
ccgcccggaatccgggcgacccaccgtcgggggagcagactggccccgcactgtcccatcttgcacatgggtccgcccatggagcacggatggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcaggcacgttcgcacacagacatggggaacttggcatgacgttcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttaagaaaacaagaccccctcggagccctaaaacaaaagaaaagaaaaactgggggggggggggttttaaaaaatttttgggggggccccaattcctggctgggggcac

SEQ ID NO: 882 - DNA, 844 bp, Homo sapiens
  CDS (208)..(750)
tcatggcaagagcgagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcact

SEQ ID NO: 883 - DNA, 925 bp, Homo sapiens
  CDS (181)..(831)
tcatggcaagagcgagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcact

SEQ ID NO: 884 - DNA, 2758 bp, Homo sapiens
  CDS (91)..(1881)
atctttttgcaggatcccatcgattcgaattcggcacgagggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaaaaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattcccttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctctaatccccagtgctgtatttcttcaaggtgcatcaggcctaggacagtggttaagtgttgggagctggagatcattttatcactgagttgagatttctttttcctgcagagtgtgggagattatatttagggtcattgtattgcggccgctctagaggatccaagcttacgtacgcgtgcat

SEQ ID NO: 885 - DNA, 1455 bp, Homo sapiens
  CDS (131)..(1252)
gcacgagggtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcatttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttaaaaaaaaaaaa

SEQ ID NO: 886 - DNA, 1572 bp, Homo sapiens
  CDS (369)..(1418)
agcgtgatgtatataactatctattcgatgatgaagataccccaccaaacccaaaaaaagagatctctcgaggatccgaattcgcggccgcgtcgacccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcatgaatacacatggctctgttacgaaaaattaatcaggtgctgctgttccttctgatcgtgaccctctgtgtgattctgtataaaaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattaaaaaaaaaaaa

SEQ ID NO: 887 - DNA, 1986 bp, Homo sapiens
  CDS (579)..(1484)
gccgtaccggtccggaattcccgggtcgacgatttcgtccttgagcccagtgggtcaaggctgctttgagccgtgatcatgccactgtactccagtctgggcaacgggaagactctgtaaaagcgaatgattaaaaataagtgttgggattatattttctttggatttctcttttctatttaaagattgccctatcagaatcccatcttcatttttttgttctttctgacataggttttcaagggacatgagtgacccgaggatggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttaaaaaaaaaaaa

SEQ ID NO: 888 - DNA, 2532 bp, Homo sapiens
  CDS (92)..(1156)
gcacgagcggcacgagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaaaaaaaaa

SEQ ID NO: 889 - DNA, 1948 bp, Homo sapiens
  CDS (39)..(1127)
atttggccctcgaggccaagaattcggcacgagggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaatgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccccattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttaaaaaaaaaaaa

SEQ ID NO: 890 - DNA, 417 bp, Homo sapiens
  CDS (1)..(297)
atggattgctgtgcctctcgaggctgcagtgtccccaccgggcctgccaccaccatctgctcctctgacaaatcctgccgctgtggagtctgcctgcccagcacctgcccacacacagtttggttactggagcccacctgctgtgacaactgtcccccaccctgccacattcctcagccctgcgtgcccacctgcttcctgctcaactcctgccagccaactccaggcctggagaccctcaacctcaccaccttcactcagccctgctgtgagccctgcctcccaagaggctgctaatggatggctactttgctcagtgcctgagattgaaaaagtcaacatagaagctttagcattcacctatctcagtacctacaactaatgtactctgctttagaaattggaacaaggatggag

SEQ ID NO: 891 - DNA, 2290 bp, Homo sapiens
  CDS (153)..(1436)
ccacagccacctccggagggatctggctgaggaggaagtggaggtgtcactggccccggcctttgccccaatcttgtgtgggcactgaagggggactacaggttcgagatacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctaaatgatcacgatgagatttaatgcccatatcttaccagttcagtaatctccagagccatttcaccctttagagtgagtcacatgcagggagtgtgaatgtcagaggtggtttattatccagtctgccttacccttaatctgttcacagatatttatttactaatgcctttctttctaaagagttatgggataggaaaatgaaagtgtttgctcctcatttactaaatgatcgtaaacttgacgttctcattcaaatataattccccttctgtcgaattactggcctcgagggccaattcctatatgagtcgtattaatt

SEQ ID NO: 892 - DNA, 1265 bp, Homo sapiens
  CDS (193)..(1134)
cgaattgggcccgacgtcgcatgctcccggccgccatggccgcgggatttcccgggtcgacgatttcgtaggaaggagagttcttcttccaggtggtttcctgcagactgcctgctagggctcagaggaccagcttcttccctgctgtctcctgagcccagtccctcttggccatcacattccccttgccctatggcggccctcacagacctctcatttatgtatcgctggttcaagaactgcaatctggttggcaacctctcagagaagtacgtcttcatcacaggctgtgactctggcttcgggaacctgctggccaaacagctggttgatcggggcatgcaggtgctggctgcttgcttcactgaggagggatcccagaaacttcagcgggatacctcctatcggctgcagaccaccctactggatgtcaccaagagcgaaagcatcaaggcggcggcccagtgggtgagggacaaagtgggcgaacaaggcctctgggccctggtgaacaatgctggtgtgggcctgcccagtggtcccaacgaatggctgaccaaggatgactttgtgaaggtgattaatgtgaacctggtgggactgatcgaagtgacccttcacatgctgcccatggtcaagagagcccggggcagggttgtcaacatgtccagctctggtggtcgtgtggctgtcattggtggtggctactgcgtctccaagtttggcgttgaggccttctctgacagcataaggcgtgagctctactactttggggtgaaagtctgcatcattgagccagggaactatcggacagccattctcggcaaggagaacctggagtcacgcatgcgaaagctttgggagaggctgcctcaggagacccgggacagctacggagaggattatttccgcatctatactgacaagttaaaaaacataatgcaggtggcagagcccagagtcagagatgtcatcaacagcatggagcatgctattgtttcccggagccctcgcatccgctacaaccctggcctggatgccaaactcctctacatccctctggctaagttgcccacccctgtgacagatttcatcctaagccggtaccttccaaggccagcggacagtgtctaaactggggaggatcaatgggtcagtggagcctagaagtgggggaggaaggaaggaccgtggggtcacaaaaggtggtatcggttatcctgggggcattggctgcaaaggaagcttggctcacttgacaccca

SEQ ID NO: 893 - DNA, 4531 bp, Homo sapiens
  CDS (1)..(1707)
atggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttttacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcccttgccctgctcatccacagcaggtgacaactgatggcttctctgccctgccctggccactggccctgtttctcccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttacggcctttacatgaatacgtcttgatcagacattcagagattagtcttaggtttccacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcgctctgttgaccaggctggagtgaagtggtgtgatcccagctcactgcagcctcgacctccctggcttgagtgatcctcccgccccagcctcctgagtagctgggactagaggcacgcaccaccgcgcctttttattttttttgtagagacagggtctcactgtgttgcccgggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtgtgttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcttctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaa

SEQ ID NO: 894 - DNA, 3804 bp, Homo sapiens
  CDS (1478)..(2695)
ctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggtaagggctcctgcagggcctgggggcatccacatggccaggtgccctgggggtgtggggtgtgggaggaggccggggtcagggggctcgggcaggcctgctgtcctccctggacgcctcactgtgctcagcagctctgagccaggcattgcgctcctctgtggcctccagagaccagcccgaggctgtcaggacctggaagcacggtggccagtgccccttcccctgtctgcagcccctcccctgtgctagcggtggtggctgctttccaggctgaattactgggggagagcaactcatccatcagggcaaagggtggaaggaggcttaacagagagcgtagcttttgagctagaaagggctgatttggtggaggggagcgccgtggcttcctgcccagctgcgggcaggacagtgccccggccctgaggctctctctgccccacaggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccacccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtactaccaactattcgggaggctgaggtggaagaattgcttgagcttgggaggttgaggctgcagtgagccaagactgcatcactgcactccagcctaggtgacagagcaagccccgtctcaaaaaattaataaggctggatgcggtggctcacgcatgtgatcccagcactttgggaggctgaggtgggtggatcacaaggtcaagagctcaagaccatcctggccaacatggtgaaaccccgtctaacaaaaattagctgggcgtggtggcgcacgcctgtaatcccagctacttgggagactgaggcaggagaatcacttgaacccgggaggtggaggttgcagtgagccgagatcacgccactgcgttccagtctgggcaacagagtgagactccgtcacacaaaaaaaaaaaa

SEQ ID NO: 895 - DNA, 1510 bp, Homo sapiens
  CDS (65)..(988)
gcacgaggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttaaaaaaaaaaaaaaaaaaa

SEQ ID NO: 896 - DNA, 2092 bp, Homo sapiens
  CDS (274)..(702)
agccttcggtaccggtccggaattcccgggtcgacccacgcgtccgctctcccccccccctcagcctctctctctctctctctttctctctctctctctctttctggctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaatgggggtgtcgtttgtttcctaccccaacctgctttcttgacccagttctcagggaacctgaagggacacaggatgccggtgataagctcacctcttcaggaagccgcttcaagcagacctgccaccttcaagcagaccctcctcacttaagccacttggccacttccccgaaaccgtgcttccttaaaaaagagaaaatgaaagttgtttttaaattaattacaaagcagagattctttctgtttgagatttagaggaactgggcttgctcgcacaggcagacaatgccagtggccggccgtctgcccccgcctcaggcgggccggagccctaaccacgatcctcgcaggctcggcctaaccacgattcgcctcttcctgtgcggtggccagaggcagcttgcgaaggaacc

SEQ ID NO: 897 - DNA, 1880 bp, Homo sapiens
  CDS (138)..(1463)
tatagggagacccaagctggctagcgtttaaacttaagcttggtaccgagctcggatccactagtccagtgtggtggaattcgtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggccccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaaaaaaaaaa

SEQ ID NO: 898 - DNA, 2688 bp, Homo sapiens
  CDS (209)..(895)
atggcattcccgggtcgacccacgcgtccgccgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcacgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaaaaaaaaaaaa

SEQ ID NO: 899 - DNA, 2181 bp, Homo sapiens
  CDS (184)..(1236)
atagaacgcctgcggtaccggtccggaattcccgggtcgacccacgcgtccgcccacgcgtccgatagattgcttgtgctgcctgataattactcgcacttttcccaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataacccaagtaaggttctcaaatgtagaaaattataaatgttaaaaggaagttattgaagaaaataaaagaaattatgttatattatctagactacacaaaagtaagccacactatatcttcatgagttgcaaatccatggaaacacagtaaaccagccctgaaacaaagcatttccttgttttcagtggtattagatcttgtttccacatgtctgtctcattcttcactgggccttacaggttagttttaattaactctatggtatttttcttattcttgtttgatcatgttaaaaattggacctaataaaagtattttattcttgcttttccatgcttctctacaggtccaaatactgaatgtctcctttactttttctcttttaaatttttttctagacagggtctcactctgtcacctaggctacagtgcagtggtgtgatcacagctcactgcagcctcgacttcccaggctcaagtgatcctcccagctctcagcctccaaagtagctggcactacaagtgtacacccccacacaaggctaagttttgtattttttgtagagacagggtttcaacatattatccaggctggtgtcgaattcctgggctccagggatccacagtcccccttggcctcccaaagtgctgggattacaggccccttgttcagccactgcacctggccccttattttgtttttgttttctaatatactttgatgtaatcagcttgagaaagcaacacaatttcaaatcctatcttctagatgcaagcagtgttaaatttgttaataaatttgcttttcacacctttctttaaataaaagtcgaccggccgcgaatttagtagtagtaggggccgctctagaggatccaagcttacgtacgcgtgcatgcgacgtcattagctcttctatagtgtcacctaacttcggtccattgca

SEQ ID NO: 900 - DNA, 2885 bp, Homo sapiens
  CDS (339)..(1532)
aattgatagctgtacgcctgcgcgatgagacctgtattcccgggccgacgatttcgtcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacat

SEQ ID NO: 901 - DNA, 1732 bp, Homo sapiens
  CDS (477)..(1307)
cgtgcgtggaattcggcgtgcttgctgctggagggtgatggccctgcaaggctgtgggctccgacctcaccgggagtcgacagcgagaggttcgccgaaaagcgaggttctgggcgagcgctgaacgccggccccaagcaccccgggtctttacacagtccgcggccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaa

SEQ ID NO: 902 - DNA, 839 bp, Homo sapiens
  CDS (178)..(657)
tggtggaattcctgagccgttgccttggctacaccgtctgttagggccgcgcacgagatcagtaactgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacacatattgcttattttttctacttagttcagaaaaatgatgttgaattgtgtgtttcagggtgaagatgaggttcacttacatatatcatttaacatcagtgtaagatgcaattaaaatagatggaagacaaga

SEQ ID NO: 903 - DNA, 2603 bp, Homo sapiens
  CDS (160)..(1647)
  misc_feature (1)...(2603): n = a,t,c or g
gcggtggaattctgcgcgcagctccaccgttgccaagacgccgcgtaaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgtatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttcttttaaagcatcttttttggtctactgtaagggaggagaattataaatgaaaagagtcaagaattttattatctgatgtgcttaattgtcatgctaagaacttaaaaaacaactcaaaaagagctaatagctaatctcctaaatctaaaaagggaattctttgaaattattttgctttcataatcaaatatattacttatgaagaataaaaataattcaaaccactacaataagtaaaatgggtatccatcacatactgtcatagagactaactgaagtagatcacttatgaatttccccattcaagtgctttcataaattcctcctcagtgaaagatagcatcttggcagcttcaatatgcatcttttgcctttttaaaacatcaattaattttaactgtttcttgaaccctatcattaattctcctttttgtttttctagcttcttgttttctgattttaacacttcaatttttttgtgttcttcatttgctatgtccttgttattttgccttaatttaccggacgcgtgggtcgacccgggaattccggaccggtnnnncnggcgtgacggctgtcaatcaat

SEQ ID NO: 904 - DNA, 1678 bp, Homo sapiens
  CDS (482)..(916)
atttggccctcgaggccaagaattcggcacgaggagcctccgaaataagaggagcaggaccagaagaagagcagccattgttctctgcagacagacacattctctcacatgtccccggggccacagacctctttatgttctaactgggtctgcacagaagaggcaggagacaggctttagcctcaagggagggagagagaggcaagaggccacagtccccaagttaggaggccacaaggaaagaaaaggacttctgtgaagaaaagagtcccgtctgagttgcagtccacttgcctggggccactggaggagatggggctggggaggggccgctgcagggaggagggcgggggtcagcggctgtgacatgacgcacgtgcctctcctgggcttgaaattgaagaactgaggaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcaggggccctgactgaagactgtctggcaggtggaacggtccttggtcctctccagccaggcccagcaggcactaccttcatgaagtctccagcaaacctcttcctcacaagtggtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtg

SEQ ID NO: 905 - DNA, 1434 bp, Homo sapiens
  CDS (307)..(1164)
atacggccgagcttcgttcgggcacttccagtactctcattcacttcctgtccctttcttttacgtttccgacaaaacagtgtctgtgggcagctagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggcaaaaaaaaaaaaaaaaaa

SEQ ID NO: 906 - DNA, 1196 bp, Homo sapiens
  CDS (153)..(1058)
gcttgggaagaggatgatgtatataactatctattcgatgatgaagataccccaccaaacccaaaaaaagagatctctcgaggatccgaattcgcggccgcgtcgacccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaaaaaaaaaaaaaaaa

SEQ ID NO: 907 - DNA, 1816 bp, Homo sapiens
  CDS (105)..(1070)
  misc_feature (1)...(1816): n = a,t,c or g
caggcctcttctgcctctgagggacgccagacgagtcccagagccgaccgcgctgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccagggaaccagcttgctggcccacccttggagatcacgcaggaagcgggcgagatggtgtttgtgcccagtggctggcaccaccaggtgcacaacctgggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcagggtgaaggcccaatggaggtcagggacccaagatggggatggtggcccttctgacctgcaagcagggcctgctggggnagctcgggagaatgggtgccagggacctnggcttcttttgggggggcccctggccttcctttanggccaaggnacgccctga

SEQ ID NO: 908 - DNA, 1995 bp, Homo sapiens
  CDS (117)..(1031)
ctgacacactatagggaatttggccctcgaggcaaggattcggcacgaggatgaataaaaggttatttgagccaaattacaggaatgtgtaatacttgagggttagctggagaacaatgaccaggtattgggagggctggtctcaacacatttcactcttcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgccccggctgctgccttgcaactgaatggagcagttcccttgggggccctgaatccagcagctctgactgctctgagtccagccctgaaccttgcctcccagtgtttgcagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaaaaaaaaaaaa

SEQ ID NO: 909 - DNA, 2268 bp, Homo sapiens
  CDS (445)..(1539)
tcgtcgcctgcggtaccggtccggaattcccgggtcgacccacgcgtccgcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcagggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaacatgcttctcttagaggttaagcagggtcattaacatcctcccccagtccctaacatg

SEQ ID NO: 910 - DNA, 1116 bp, Homo sapiens
  CDS (163)..(789)
gaggttagtaaggggggttgatgtgcactacggatcgccgccggctaatatgaaccctcactaaagggaataagcttgcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttctcagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaaaaaaaaaa

SEQ ID NO: 911 - DNA, 2038 bp, Homo sapiens
  CDS (186)..(1607)
ccgttcggaattcccggctcgacccacgcgtccgcggtcccgaggtacgcggtgcggtctcccggtacccggagcggctctgattcatggtttaacttgtggccctaaagaactggaaacccaaaggaacgaatattcctgccccacagagtcccgtctttggtgaggctgtttctggagtttacatgatgaccaaggtactaggcatggccccagttctgggccctaggcctccacaggagcaagtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttaaaaaaaaaaaa

SEQ ID NO: 912 - DNA, 1276 bp, Homo sapiens
  CDS (308)..(523)
aatctggtacgcctgcaggtaccggtccggaattcccgggtcgacgatttcgtggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcaaaaaaaaaaaa

SEQ ID NO: 913 - DNA, 891 bp, Homo sapiens
  CDS (95)..(856)
tgcggtaccggtccggaattcccgggctgaacaacacgtacgcacagtgacgcaggcccgctgcagaatattgactctatccagcgaccgatacatggcatcctggccgtcagtctaccacgtagtgagcgggaagatgctgatcctttacgacaaagacccctgctcccctgtttctgtgccctacttgagtcctctagtactccgtaaagaacttgaatctttgctagaaaatgaaggtgatcaggtgattcatacatcttctttcatcaatcaacatccaatcattttctggaccctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggctt

SEQ ID NO: 914 - DNA, 1466 bp, Homo sapiens
  CDS (779)..(1213)
  misc_feature (1)...(1466): n = a,t,c or g
tcccgggtcgacccacgcgtccgggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaatanagctaaataaataaataaataaataaataaataaatagtatgattcttctatgaaatcaggtgaattttataatacgaaactcaccatgaaaatatgactttcaaatttcaaaaatccatcctgacacagtggctcaagtcttaggccagctactcggggggctgaagcgggaggatgacttgaagcaagttcaagaccagactgggtaaatgaaactctccccgctttaaaaaaaaaaaa

SEQ ID NO: 915 - DNA, 2302 bp, Homo sapiens
  CDS (213)..(1766)
taagcttgcggccgcagaagcgtagaccgagtagcttgagcgcctcttccggttaccttttcccagtgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctaccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaa

SEQ ID NO: 916 - DNA, 2318 bp, Homo sapiens
  CDS (103)..(1686)
ctcggaaccggcccggaattcccgggtcgacccacgcgtccggagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaaaaaaaaaaaa

SEQ ID NO: 917 - DNA, 1295 bp, Homo sapiens
  CDS (107)..(1006)
ggtaccgctccggaattcccgggtcgacccacgcgtccgctccaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaaaaaaaaaaaaaaa

SEQ ID NO: 918 - DNA, 3376 bp, Homo sapiens
  CDS (1)..(2808)
atgagggacctggagctcagagaggttaagcaacttgcccgaggtcacacagctggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagttgcccctggcacagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaactataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttaaaaaaaaaaaa

SEQ ID NO: 919 - DNA, 3232 bp, Homo sapiens
  CDS (157)..(1176)
aaattgagaactgaggccgtacgcaagagccaccggaccggaattcccgggtcgacgatttcgtctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtagtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctcaaaaaaaaaaaa

SEQ ID NO: 920 - DNA, 571 bp, Homo sapiens
  CDS (63)..(425)
atgactgaggtaccgctccggaattcccgggtcgacccacgcgtccgggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaaggtgctggtgcctgggatagtcaaaggggaaatgaggggtaggggtcatctgggctgaaacctaacagcggcagagagtgattggacagggtctggccctggagcactgtccgtggtgctgaaacaggtcctggattgctgctggggggcagtaatttgacagatggggccgctcactctgctgggattagaaggctttgagcg

SEQ ID NO: 921 - DNA, 2312 bp, Homo sapiens
  CDS (778)..(2067)
cgtggcctcggaaagaaagcccacaaaatagttgctgaagtggaaggagacagcactctcgtaggctcgcagccacttgcgaaggaggcggtcaccgttgagggggatgaagtacgggaagaggtaggggcccacgcaagtggacagcacaaggcacagcagggccagtgccaggctccgggccaccttctgcagccaccggcagctcagtgggcggccttggacagcttgtaggtagctgtggaaggatatccagggcccgaagacgatggtgcccacgaagtagaggtagcccatgaactccactggcgagggcaccgtacccacctcgccccggtccaggtcgaagcccagagacactgccttcatggccacaatcatctgtgcccctcgcatcttgtgccatgtcacggtgtctaccatgtgcatctcacccatgagtaggtagatgaggatggtgacggataggaagacgcctcgatgggaggaatgtcggcagaggaacagcacgaggtagcacaggaggctgagcagcacgacccaaaccatgtgcagctggaagaagtggtagaggctgaagaacccgcctgccacggtgcttgcatgcttcaggtaggatggcaacccgagcctccagaggaggcggcaggcgaggcagatggcaaggagcagccagatctggtcaaggccctgctgggcagtaggcaggagacagccttgcagtagctgctggaaaaattcctggcggctaaaggtggccattgcagacccccacggatggatggccagatggatagatctggcaggaaagaagccgtggtcctggggaccgaggacgcgctgccgccgccgctgcctcctccgggcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgagggttactctacctaaaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcgg

SEQ ID NO: 922 - DNA, 1716 bp, Homo sapiens
  CDS (71)..(1543)
ccggaattcccgggtcgacccacgcgtccgtgaacatgttctttcccttttggagaatgtatttactcctatgttctgccatagggatgagtatttcagacaacttttaagaggggcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaaaaaaaaaa

SEQ ID NO: 923 - DNA, 1551 bp, Homo sapiens
  CDS (71)..(1378)
ccggaattcccgggtcgacccacgcgtccgtgaacatgttctttcccttttggagaatgtatttactcctatgttctgccatagggatgagtatttcagacaacttttaagaggggcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaaaaaaaaaa

SEQ ID NO: 924 - DNA, 2366 bp, Homo sapiens
  CDS (96)..(1916)
tggcgaattcggcacgaggtgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatttgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagaaaaaaaaaaaa

SEQ ID NO: 925 - DNA, 2611 bp, Homo sapiens
  CDS (290)..(1885)
attgaagccgtggtaccgctccggaattcccgggtagacccacgcgtgcgaggcgttctccgcgggcagccggcggcggagccttgccttacagcgcggggtcctcggcggcctgggtggctactgcccctgctgctgtcgtaggcgaggacggctgttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgggaccgcgttgtagccgtttttgtgcagggtcctgcatggcagttcaaaggttggccatggcttttgcctgatggatcaccagttgatatatttgctaaaattaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaaaaaaaaaaaa

SEQ ID NO: 926 - DNA, 1606 bp, Homo sapiens
  CDS (58)..(1062)
gcacagctttgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaaaaaaaaaaaaa

SEQ ID NO: 927 - DNA, 1579 bp, Homo sapiens
  CDS (117)..(830)
agtcgacgatttcgtcccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaa

SEQ ID NO: 928 - DNA, 2193 bp, Homo sapiens
  CDS (350)..(1312)
tcaagattctggccaatattggttcctgatgagggctgtctttctggcttgcagacggctgccgtctacctgcgtcctcaagaggcctttctcatcatccacacattcctctggcggcccaaaggatttacttgggggatttagctcctgccatcttttgattgccattttctcatggaagatatagcttcttagctgggccggaagcagatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtg

SEQ ID NO: 929 - DNA, 2067 bp, Homo sapiens
  CDS (350)..(1186)
tcaagattctggccaatattggttcctgatgagggctgtctttctggcttgcagacggctgccgtctacctgcgtcctcaagaggcctttctcatcatccacacattcctctggcggcccaaaggatttacttgggggatttagctcctgccatcttttgattgccattttctcatggaagatatagcttcttagctgggccggaagcagatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccagtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtg

SEQ ID NO: 930 - DNA, 1243 bp, Homo sapiens
  CDS (172)..(702)
caggttacatggccaagattgaaacttagaggagtatagttacataaaagaaggcaaaacgatgtataaatgaaagaaattgagatggtgcacgatgcacagttgaagtgaacttgcggggtttttcagtatatacgattcatagatctggaattcgcggccgcgtcgacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactcccaaaaaaaaaaaa

SEQ ID NO: 931 - DNA, 2710 bp, Homo sapiens
  CDS (218)..(1645)
attgattaccgttgcggtaccggcccggaattcccgggtcgacccacgcgtccgcacgtggtacggaaccggcgccgcgcttgctgctggtaacagggccttgcctagtgggccttccttcccaggtcgcccgtcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctctgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaaaaaaaaaa

SEQ ID NO: 932 - DNA, 1997 bp, Homo sapiens
  CDS (72)..(1748)
attgaaaacccaattgataagctgttacgcctgcaggtaccggaccggaattcccgggtcgacgatttcgtatggagtcagccgggctagagcagctcctacgggagctgctgctaccggacaccgagcgcatccgtcgggccacggaacagctccagatcgttcttcgggcccccgccgctttgtcggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttcactgccatcatggagcacctgcgggaattcctgttaacaggccgtgagaccttcagcctgtgcagatacagagcatggagacactgggggtgctggacacaacaagtggggagcccataaagcccgctggtgaggaaatgctgcacattgggtcctggactcctccaacaggttgacaaccctaacttgcggcctgccactttcaacctattggaagcctttatgggtcctgtgggttaggggctggcgccccaacttggaaaaaataacaaactcaatgctgttgtgactgggtttcaacggggggcattgtgcctcagtatgagggaagaactccttccctttattgacacatgaagattagtggga

SEQ ID NO: 933 - DNA, 3834 bp, Homo sapiens
  CDS (663)..(1472)
taagcttgcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagaatcctgccgagtctttctttaaggagcctgattcgggctcgcactctgcccagtccagcaccgactcgtcggcggccacccggggcctcgactggctggggtgcccagcatgtccgctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggttttttttttttcttgatgttgtttgtttgtttttgagatcgagttttgctcttgttgcccaggctggaatgcaatggcacaatctcggttcactgcaacctctgccttttgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaaaaaaaa

SEQ ID NO: 934 - DNA, 771 bp, Homo sapiens
  CDS (363)..(662)
atttggccctcgaggccaagaattcggcacgagggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaaaaaaaaaaaa

SEQ ID NO: 935 - DNA, 893 bp, Homo sapiens
  CDS (204)..(893)
ctaccggtccggaattcccgggtcgacccacgcgtccgcggacgcgtgggcggagctcggcggtctgcgctcggttgctagccgtttgctcccgctttcagttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatag

SEQ ID NO: 936 - DNA, 1248 bp, Homo sapiens
  CDS (279)..(932)
gcacgagggcaagttggcctctctgttgtaaattagtggttaaggttatctattattgccacttttccagcgctaaaggctgttttggaaccagtgttgcttgttccgcgggtgattggctttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccgggaggagagagaatgtcttttcgaggcggaggtcgtggaggctttaatcgaggtggtggaggtggcggcttcaaccgaggcggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaagcatatttgaatttttaaaataaagtgttttattcccttaaaaaaaaaaaa

SEQ ID NO: 937 - DNA, 1344 bp, Homo sapiens
  CDS (53)..(874)
accgcaattcccggttcgacgatttcgttaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgaaaatgcgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatactttttttttttttggagggatttcccttgttgtgcccaaggttgaagggcatgggcccaatttgggttaatggaaccctcaatttccagggttttagg

SEQ ID NO: 938 - DNA, 903 bp, Homo sapiens
  CDS (82)..(903)
ccgggtcgacgatttcgtatctgtgtaagacgtgacttgctcctccttgccttctgtcatgattgagaggcctccctagccatgtggaactgcttatccaaatcccttgggctcattgaaggttatggtgggcggggaaaagggggccttccggctactctttccccggctgaagaaaaaaaggctaagggaccccatgagaagtatggctacaattcatacctcagtgaaaaaatttcactggaccgttccattccggattatcgccccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggtctgtggctgggctcaacgaatatgtaacttcacagatgaggacaagtgattcttcagtgacttcaaatgtcagcagcatgatgtga

SEQ ID NO: 939 - DNA, 1831 bp, Homo sapiens
  CDS (345)..(995)
taagcttgcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgacattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaaaaaaaaaaaa

SEQ ID NO: 940 - DNA, 1232 bp, Homo sapiens
  CDS (275)..(1141)
agccggggactagcggttcctttccgatgctctttccatctgccctccacgtgacagggcttgcgctgcttctatttatcagtttgcttgtttcaggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggctttcctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtac

SEQ ID NO: 941 - DNA, 1473 bp, Homo sapiens
  CDS (286)..(492)
gccccccatgaaatcgaaaacttttacgcctgcaggtaccggtccggaattcccgggtcgacgatttcgtgacgggtcgcagggggtcgcctggccggagctgggctccgagaatcccgggtgccagcaccagagcagcggctctccgcactaactctcctctcctggtcagctgtaacccctgccgcagagcccggcaactttcagctgtcgcccgcggagccccgagggccactcgcctcacctgtgcgtgcagcgcctcgcgcgccctgtccggctgcggagatgagcgagcttaataccaaaacatccccagcaaccaaccaggcagctggccaagaggaaaaaggaaaagctggcaatgtcaagaaggcggaggaggaggaggagattgacattgatctgacagcaccagaaacagagaaggctgcccttgctattcagggcaagttccggcgatttcagaaaaggaaaaaggatcccagctcctgaatggccaggcttgcccttcaccttcaccttcatgctgggcccttctctccccttctccacacccatgtatctttatcccttgtccctctagcctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggctctttgatcagtagctatgcctgccctgtagggctaaacaagaggcttcgaggctgagagatctccccaaagaacaatgtgggaaggaggggaaggctttcagagtagggtgcctgagggtgggacatatgcactgttctgctagttacggcattcacactttaggtaacattttttttccccttcagatccttctgcaccaactccaacttcccctcccaggatctaagccacagtggggactggagcctcgttttccccctaggcagacctaaatcaagcagcttaccacaatagtgcatgctgagtagattagttccaaggaagggagactggaatgctggtgtcaaggaaaagcctccctcatcatctagtctaagaccataacgggcagaagcataagaggttccagggccataggagaatgagaagtagggcacatatagggaggaaagaaaagtgaagaagggggaaatctctgaatttttttactgctgggaaaagtgtactacatgaaggatgcttggggctttgctaacctgctcaccgctaaccctccaagtctaaccatccccagaggccacacaaaccaagtgactcctgtagttcccatttgccccactatggagtcagggcaaaagtggaatagccactccatgtgattttagcatgtttaatcattttaacaataaaccaccccacaaatggggtcatttaacctctaaaaaaaaaaaaa

SEQ ID NO: 942 - DNA, 819 bp, Homo sapiens
  CDS (68)..(628)
tgcggtaccgctccggaattcccgggtcgacccacgcgtccgtgtcatttctgtattcctctaaggcatgaagtcattatgcaacttacacatattcatcagatttcctctgacttacccggacatgtacatgggaatgatgtgcactgccaagaaatgtgggattaggtttcagcctccagctattatcttaatctatgagagtgaaatcaaggggaaaattcgccagcgcattatgccagttcgaaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccagcactttgggaggcttaggcgggtggatcacctaagggcaggagttcgagcccagcct

SEQ ID NO: 943 - DNA, 1008 bp, Homo sapiens
  CDS (93)..(800)
aaggatccttaattaaattaatctccccccccccgggttgctctggagccgggtctcgggtctggtggctgccggtcctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcaaaaaaaaaaaa

SEQ ID NO: 944 - DNA, 1711 bp, Homo sapiens
  CDS (138)..(743)
gtccggaattcccgggtcgacgatttcgtctttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgcacttctggtaacccgacatttgctttgtgtcctggtgaccgctgtagccctacgtgcagtgaggcttgtctaattcaattacaggttcaagtgtatttttcatctcaaacctctaatatttctttggagttgagttgcttagcatgtggaatttctccagctgtcagtagcctgatgattttatggttgttatagtaaattgctatcattttaaaaaaaa

SEQ ID NO: 945 - DNA, 1108 bp, Homo sapiens
  CDS (172)..(771)
ccggaattcccgggtcgacgatttcgtgcgctgcgcctgcctccgggaggagccgcatccacacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactac

SEQ ID NO: 946 - DNA, 1193 bp, Homo sapiens
  CDS (55)..(1104)
ttgtggtaccggtccggaattcccgggtcgacgatttcgtcggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatattaacacacatggtaccagaaaaattcccaagcatgtattgcggccgctctagaggatccaagcttacgtacgcgtgcagagcgaactgaact

SEQ ID NO: 947 - DNA, 1251 bp, Homo sapiens
  CDS (452)..(1222)
taagcttgcggccgcataggttttttttttttttttttttttttccactgaaagcattttaatacggaacttgtcactcccagggagcctccgctcagccggcagttggttcatttcaatccccacgacaacccttcaaagtgcagggcagacagcaggtggctctgcccaggcgcctggatcacagcccggcctgcagccctcacctgggcgcggggagaccctgaggacgctcctccaggcggcgctggccggggcccgtcccagccccgccgcccgcagccccagctgcaacgcagccaccgccgccatcgcacccggccccgcgggcgcttccgggacgcaggaggcatctgcatccggggcgccgctgagtcccgcccagagccccgcccccggctccaggttctgcgagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaaaaaaaaaaaa

SEQ ID NO: 948 - DNA, 2391 bp, Homo sapiens
  CDS (668)..(1930)
agccctccgcacgcaggcaccggaccggaattcccgggtcgacgagttcgtgcgttttacgcaggctgtggcagcgacgcggtgaggagacggcccacggcgcccgcgggctggggcggtcgcttcttccttctccgtggcctacgagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaa

SEQ ID NO: 949 - DNA, 1205 bp, Homo sapiens
  CDS (375)..(1205)
gaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacgcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggcttcaggtggtggctgccatgccctggtgtttcctggcctgtgaccgcatcattccaatctctgcctccatcttcacgtggccttttctgtatgtgccggtctaa

SEQ ID NO: 950 - DNA, 645 bp, Homo sapiens
  CDS (245)..(514)
ggagatacgctctgcgcggggaacccgggggtccgggggccctaacttttgagttttgcacgccccgcagcctgagatgggaaggtagctcgtcgcgctccaaactcacctgcgtttcagaacgacatctacccactggtttcagctcctagagcaacaactgcagaatctccatggtccaaagtcctccagaaaagagaagaaaggggtgacggggaacactcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagcatggaaatacggtacctgaaatgggacacactgagtagataggtcatcccagaccaagatatgcaagagaagccacaacctgctgcaattgggcatcaaacacatatggtcgtcataaataaatcatatcctgttctcaaaaaaaaaaaa

SEQ ID NO: 951 - DNA, 1169 bp, Homo sapiens
  CDS (258)..(821)
gggggggtggtataagaggtaacaagcatcagtctcatctaaatattaaccctcactaaagggaataagcttgcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaaaaaaaaaaaa

SEQ ID NO: 952 - DNA, 2114 bp, Homo sapiens
  CDS (126)..(2114)
ccgccctcgtgagcacatcgcgcctatttaggtgacactatagaacaagtttgtacaaaaaagcaggctggtaccggtccggaattcccgggatatcgtcgacccacgcgtccgcggacgcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgccacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacaggttctgctgaatgtcctgaccttgaaccggaacctgagtgacagcctggcccgcggccgcctacacccggacctgcagtccaacctcctgcaggtggacagtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtag

SEQ ID NO: 953 - DNA, 1234 bp, Homo sapiens
  CDS (75)..(779)
ccacggtgcaagtctaaaataaccctactaacgggaataagcttgcggccgcgggggtgccggccggcgcgggcatggggagggccggcgccgcggccaacggcaccccgcagaacgtccagggcatcacctcctaccagcagcgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggtttgcttcccaccagcgagtgatcagtttcttctgtaggacccctgtcaggaagaacatgcctggatcctacttcagagagaactcagccagggcaaggggctcctgtggctttttgggtgggtgtgagttcatagaggggaaatcaatactgtaccaggatttagacaatttagcaaaatgcacgaggcagtactttggatgatgaataactacagctgcatggctaacccattggttgtgtaaagtatgggttatcatgttttgtctaaattttcaggcaaaatctagcctgttttgtggcattaggatcatcattatagtagtatgatttttatgctattatacttacgctatgtcccgaatgtttttaaggccagcaaaatggaaacagtagagtacttgcctgaatgcaaataaacttcagtttcaacttaaaagacaaggagggaagaaacccctgtgccgaatctcatgtcgagggcaactcctat

SEQ ID NO: 954 - DNA, 641 bp, Homo sapiens
  CDS (103)..(360)
tatagggaatttggccctcgaggccaagaattcggcacgaggggacgggccagcggtgcacaagaagagaccgaggcgggtggccccgagagagccagggccatggaggccaacatgccgaagcggaaggagcctggcaggtctctccgcatcaaagtcatctccatgggcaacgccgaagtggggaaaagctgtattataaagcgatactgtgagaaaagatttgtgtctaaatacctggcaacaattggaattgactatggagtcacaaaggtacacgtcagagacagagaaatcaaagttaacatctttgatatggctggacatcccttcttctatgaggtaagaaagcctttttgacaaaacctatatccagtattgttggtggtttggggagagatccagaattatatgaaacaaccaatattgatatcatgtgtaaaattgcataattttagcttgatcgtggcttgccttcagagccttgagttaatagacaactgttgattttttaggttatcctgttaaatagtggtaggaaatttcattgccaatatttcaaacatttcaataagacattttgactttcagaggacttttgctttttacctcatactttagcctaaaatgtgaaaaaaaaa

SEQ ID NO: 955 - DNA, 1884 bp, Homo sapiens
  CDS (69)..(1700)
ctaaggccttatttgagaaggtgaagaagttcaggctgcatgtggaagaaggtgatattctatatgccatgtatgttcgccagactgtacttaaagttatcaaattcctaatcatcattgcatataatagtgctctggtttccaaggtccagtttacagtggactgtaatgtggacattcaggacatgactggatataaaaacttttcttgcaatcataccatggcacacttgttctcaaaactgtccttttgctatctgtgctttgttagtatctatggattgacgtgcctttataccttatactggctgttctaccgttctctacgggaatattcctttgagtatgtccgtcaggagactggatttgatgatattccagatgtgaaaaatgactttgcttttatgcttcatatgatagatcagtatgaccctctctattccaagagatttgcagtgttcctgtctgaagtcagtgaaaacaaattaaagcagctgaacttaaataacgaatggactcctgataaactgaggcagaagctacagacaaatgcccataatcgactggaattgcctcttatcatgctctctggccttccagacactgtttttgaaatcacagagttgcaatctctaaaacttgaaatcattaagaacgtaatgataccagccaccattgcacagctagacaatcttcaagagctctctctgcaccagtgttctgtcaaaatccacagtgcggcgctctctttcctgaaggaaaacctcaaggtcttgagcgtcaagtttgatgacatgagggaactccccccctggatgtatgggctccgaaatctggaagagctgtacctagttggctctctaagtcatgatatttccagaaatgtcacccttgagtctctgcgggatctcaaaagccttaaaattctctctatcaaaagcaacgtttccaaaatccctcaggcagtggttgatgtttccagccatctccagaagatgtgcatacataatgatggcaccaagctggtgatgctcaacaacttaaagaagatgaccaatctgacagagctggagctggtccactgtgacctggagcgtattcctcatgctgtgttcagcctactcagcctccaggaattggacctgaaggaaaacaatctgaaatctatagaagaaatcgttagctttcagcacttaagaaagttgacagtgctaaaactgtggcataacagcatcacctacatcccagagcatataaagaaactcaccagcctggaacgcctgtcctttagtcacaataaaatagaggtgctgccttcccacctcttcctatgcaacaagatccgatacttggacttatcgtacaatgacattcgatttatcccccctgaaattggagttctacaaagtttacagtatttttccatcacatgtaacaaagtggaaagccttccagatgaactctacttctgcaagaaacttaaaactctgaagattggaaaaaacagcctatctgtactttcaccgaaaattggaaatttgctatttctttcctacttagatgtaaaaggtaatcactttgaaatcctccctcctgaactgggtgactgtcgggctctgaagcgagctggtttagttgtagaagatgctctgtttgaaactctgccttctgacgtccgggagcaaatgaaaacagaataacttatttttcgttaaagtttgactgaaacacgcttctaccaaatacagtataaataattaggtagtcttaatgcctttcctatttttttttccttttcacacaaaatgtacacaaagatcgcgtaaggagtatgtatttttaataaaaatttaattgtattttttcaatattaaaaaaaaaaaa

SEQ ID NO: 956 - DNA, 1508 bp, Homo sapiens
  CDS (476)..(1378)
gcacgagggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcattagctttgggaaaagtaatgaaaatataatggttttagaaatcctgtgttaaatattgctatattttcttagcagttatttctacagttaattacatagtcatgattgttctacgtttcatatattatatggtgctttgtatatgcccctaataaaatgaatttaaacattgaaaaaaaaaa

SEQ ID NO: 957 - DNA, 1742 bp, Homo sapiens
  CDS (213)..(1202)
aaggatccttaattaaattaatccccccccccccccttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaaaaaaaaa

SEQ ID NO: 958 - DNA, 2070 bp, Homo sapiens
  CDS (594)..(1355)
gatgaaccctatagggagacccaagctggctagcgtttaaacttaagcttggtaccgagctcggatccactagtccagtgtggtggaattcttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaggtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaa

SEQ ID NO: 959 - DNA, 1106 bp, Homo sapiens
  CDS (124)..(699)
ggaagtcctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggggttgctccagctcagccccaggggacacagatgcactttgggggtgagggcaggtaatgactcc

SEQ ID NO: 960 - DNA, 1971 bp, Homo sapiens
  CDS (1)..(1884)
atggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatcca

SEQ ID NO: 961 - DNA, 1655 bp, Homo sapiens
  CDS (101)..(1282)
taagcttgcggccgcggtccgggccggggacgcgagcggcgggcgaaacgtacgctttccgcagctgagcgtgattcccgggtcgacgatttcgtggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcaaaaaaaaa

SEQ ID NO: 962 - DNA, 1000 bp, Homo sapiens
  CDS (67)..(444)
tgataagctgttgcgcccgccgtaccggtccggaattcccgggtcgacgatttcgtgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaa

SEQ ID NO: 963 - DNA, 925 bp, Homo sapiens
  CDS (67)..(369)
tgataagctgttgcgcccgccgtaccggtccggaattcccgggtcgacgatttcgtgtggggcgctatgccggggcggcacgtttctcgagtccgggcattgtacaagcgcgtcttgcagctgcaccgtgttctgcccccggacctcaaatccctgggcgaccaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaa

SEQ ID NO: 964 - DNA, 1476 bp, Homo sapiens
  CDS (149)..(778)
aaggatccttaattaaattaatcccccccccccccgagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaaccaaaaaaaaaagggcggccgctctagagtatccctcgaggggcccaagcttacgcgtacccagctttcttgtacaaagtggtccctatagtgagtcgtatatagcagcccgctacagcagtgatcatcacccacctgggg

SEQ ID NO: 965 - DNA, 1548 bp, Homo sapiens
  CDS (202)..(936)
atggccgaggcgtcgccgcatcccggacggtacttctgccactgctgctccgtggagatcgtcccgcgcctgccggattatatctgtccgagatgcgagtctggttttatcgaggagcttccggaagagaccaggagcacagaaaatggttctgccccctccacagctcccacagaccagagccggccaccgttggagcacatggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacaaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaaaaaaaaaaaa

SEQ ID NO: 966 - DNA, 1547 bp, Homo sapiens
  CDS (115)..(1203)
tacgcctgccgtaccggtccggaattcccgggtcgacgatttcgtgcctggcgcgctgcggcgctcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatgatttcaaggttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttatgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaatctgagatcatgtgaacatataatacaatgttgattttcttctggtgtattttgcacagacaagcatctgccttaaaatatatacacttgtacaaaaaggaagtttggagtaagtgcttccattttggtttcttgcttttttttactctgttaacatatggtgccttttacaaatgtatattaaaaaaaaaaaa

SEQ ID NO: 967 - DNA, 1426 bp, Homo sapiens
  CDS (41)..(961)
actagtatctagatgccagccggccaacagcttgcaagtcatgctcttttggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggccagagctggtggaacgtctcattgctgtagatatcagcccagtggaaagcacaggtgtctcccactttgcaacctacgtggcagccatgagggccatcaacatcgcagatgagctgccccgctcccgtgcccgaaaactggcggatgaacagctcagttctgtcatccaggacatggccgtgcggcagcacctgctcactaacctggtagaggtagacgggcgcttcgtgtggagggtgaacttggatgccctgacccagcacctagacaagatcttggctttcccacagaggcaggagtcctacctcgggccaacactctttctccttggtggaaactcccagttcgtgcatcccagccaccaccctgagattatgcggctcttccctcgggcccagatgcagacggtgccgaacgctggccactggatccacgctgaccgcccacaggacttcatagctgccatccgaggcttcctggtctaagagttgctggcaagaagatggccgggcgtggtggctcatgcctgtaattccagcactttgggaggctaaggcgggaggatgacttgaggccaggagttggagaccagcctggccaacatggtgaaaccctgtctctactaaaaatacaaaaattagcctggcgtggtggtgcacacctgtaatcccagctactctggaggctgaggcaggagaatcacttgaaccctggaggcagaggttgcaatgagccgagatcacaccactacactccagcctaggcaacagagcaagactctgtctcaaaaaaaaacaaaacaaaaaggaggcacaaaaccccaggcttcaagtctctgcagcctgctccacatttgggcacagaaggactcagacaggcactgtgtgggcacgaggttttacaggggtggtcagacctcaggctttaatgaataaagacactactcccaa

SEQ ID NO: 968 - DNA, 1277 bp, Homo sapiens
  CDS (736)..(1014)
ggtggggggtgaatgataatcaatgcacgcccgcttatatacgactcactatagggaccactttgtacaagaaagctgggtacgcgtaagcttgggcccctcgagggatactctagagcggccgcccttttttttttttttttcttttttattatgaacacctaggcagtgaaaactgttatgttaatacatacatagacacacccaaaacatacaaaaatactattatttcaaactactaagaataggacagttcaattattttcatgctatgactttaagagcattacactgaaacaaacaagaagttaaacgacattttttttaatatcccagaaatataccaaaatatacatctaagctttggaattactgaggttagactaatgcaagtgctgggtaatcgtacttaatacacgagtctaaggttctgcaggaaagaaattatctttggtatctgcatcaggctaatattattaacatttggattttgctttgggatagagcttgtgtgacccaagaaccaagtacccccctcccccaaccaactgagattaaaaagatccatgtaaaaagttccttcatttgcaatccccccaccccccaagttaaaaagtcacaggcatctacctagcacaaaaggttgtgaagtacaatgcatagttgcacagtggtgctgcaaaaaggaaagaaaactacaataaagagaaatgaaaagcttgataatctttctgcatgttttctcacaaacaggacagccacttccaagcagttccagtacaggaaaagaaaaaaaggctcagaagggcaccgtggcgtgcattcgcccagccccagaggttaaagcacccagcagagcagccaatcgtgcgccagtgtcttcaacgtcccccactctgtggagtcctcgggccagtccagcagcagctcccaccctccctaggccctgtgctaagtccccatagtgaccctggttggtgtagggtggatgatggtggtgatggggttttttgacttttgttttggaaaatctgaaatgccaatttgtttcagggcatgctcacaagtttgtgagggccaaagctaggggcatgcacctgtgctggaccctggaaggtggtaagcagcttgcctgccctttctgatccagtcagagggtccccccgccccaccttccctggcctcactcttttaagtgccaggacaccacagactggactgatgctgaagacttcccttttcttctcgtgccgaattcttggcctcgagggccaaat

SEQ ID NO: 969 - DNA, 2144 bp, Homo sapiens
  CDS (528)..(1607)
tacgcctgcaggtaccggtccggaattcccgggtcgacccacgcgtccgctccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcttctggaggctgggaagtccaagatcaaggcgtcagaagattcattgtctgtccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaaaaa

SEQ ID NO: 970 - DNA, 1139 bp, Homo sapiens
  CDS (38)..(1084)
taagcttgcggccgcagtgtcgcaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagcggctggagaagtaccggagcttcgaccgctaccggcgccgagcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagccagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgctctagagtatccctcgaggggcccaagcttacgcgtacccagctttcttgtacaaagtgg

SEQ ID NO: 971 - DNA, 1180 bp, Homo sapiens
  CDS (264)..(1028)
gcacgagcttcgctgcccccttcccccttttttgtccccaacttgagatgtatgaaggctttgtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaaaaaaaaa

SEQ ID NO: 972 - DNA, 1281 bp, Homo sapiens
  CDS (172)..(1074)
ccggaattcccgggtcgacccacgcgtccgggtggcggtacagacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtggacactccagggctctttgacaccaaggagagcctggacaccacctgcaaggaaatcagctgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaaaaaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatacacacattgtgaaataatgaaataaaggtaattaacacaaaaaaaaaaaaaaaaaa

SEQ ID NO: 973 - DNA, 1225 bp, Homo sapiens
  CDS (77)..(898)
gcacgagtgctcttggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggggccaccccccctcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgccaaaaaaaaaaaa

SEQ ID NO: 974 - DNA, 1583 bp, Homo sapiens
  CDS (38)..(1300)
ccttcaagtcctaacctttcccttcctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagccatggcccccagccgtatctttgtcttaaaaagtaatctctgtgcttggtaggccaagaatttaaaatataaaaaatttaaaaaaaaaaaaaaa

SEQ ID NO: 975 - DNA, 1650 bp, Homo sapiens
  CDS (383)..(1111)
atttggccctcgaggccaagaattcggcacgagacaccaggctcagtgcccacgccggggcccttggtgcacgtctggtaggcgcaggcaggtctgtgactgggagagaacatggtgccctgtgcacagcagcagaattgcgggcatctcttggctgcgtcgtggagccagccgtcactgccttgcctctgaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaattgtagttggacttttattgaatccttcctaagttattgaaaaaatgtcttttcatggtgaatgacaatatttatgttgcctttagcttcttgaagatttagaagttatataaaaaattaatttaaaagcaaaaaaaaaaaaaaaaaaa

SEQ ID NO: 976 - DNA, 1432 bp, Homo sapiens
  CDS (100)..(1200)
aggcaccgcgtccggaattcccgggtcgacgatttcgtcttcaggccactggctaccgaaccccggggctcttcaccagtccagctcgtttccagcaccatgtcggtgcggacgctaccgctgctcttcttgaacttgggcggggagatgctttacattctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccagtctcttttcagcaatctggccaccattcaggggggcctgactgggtgacagatgaatgggaaggttctgacctgttttgagtccggctcccaccttgctgtcacatatcagaatgtcactgctctgagtgtgtcccagggccttggaggtgggccgtgaggtgccgagaagcagccgcagcctcctccctccacctatcccagagcgatgctggtgatttcaaacgtatctgtcctatcagtaaataaacaagatgcagatctctggtaaaaaaaaaaaa

SEQ ID NO: 977 - DNA, 6908 bp, Homo sapiens
  CDS (1)..(2274)
atggctcccagtgtctctggccggggcctgcctctcgctcgccgctccttcccggcaacggctgccattttccgcccaggcaaggtcctgggcgcggctctggggagggtcagggacactgctgactacgtgaagccagtgaccttctcagtcgagtattccctggaggaccctgaccatggccccatgctggacgacggctggcccaccactctcagagtctcggacactgctgactacgtgaagccagtgaccttctcagtcgagtattccctggaggaccctgaccatggccccatgctggacgacggctggcccaccactctcagagtctcggtacatctcgctgcagcggtggcgaccaaacgggtgttggagttggcggcggccatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatgtttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcaccccatcctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaactaccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaactaaaaaaaaaaaa

SEQ ID NO: 978 - DNA, 1675 bp, Homo sapiens
  CDS (194)..(898)
gcacgagggcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattataaaaaaaaaaaa

SEQ ID NO: 979 - DNA, 1621 bp, Homo sapiens
  CDS (194)..(844)
gcacgagggcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattataaaaaaaaaaaa

SEQ ID NO: 980 - DNA, 1940 bp, Homo sapiens
  CDS (536)..(931)
atttggccctcgaggccaagaattcggcacgagcagttcctgctttcagaagttgctagagtgtttctctttgaacttgaactgtggctcttttgatatccagaaagagagttctttggggggatggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgaggagaatgcagttgaaactaattttgtggatagagaaactgttggaactgctttacaaagtattttaacagcccacctgaggatattgaccataaggactcatatctcattacaagaagcatcatggccgagccagactacatagaagatgacaatcctgaactcattaggcctcagaaactgatcaatcctgtaaaaacctcccggaaccatcaagatcttcacagagaacttcttatgaatcaaaaaaggggtcttgctcctcagaacaaaccagaattgcagaaggtgatggaaaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctttcagatggaataaccttccagtcccttagagagtggaactagtccatataacccagcttcagtagcaaaagtagaagccgccacatcttttcatttctccaagaggagagtggggaaggttccgtcgacgcggccgcgaattcggatcctcgagagatctctttttttgggtttggtggggtatcttcatcatcgaatagatagttagatcatcagcagtcgat

SEQ ID NO: 981 - DNA, 1489 bp, Homo sapiens
  CDS (253)..(888)
gcctcagtaattcgcacgagctaacagaaacaagaaagccttattgatctagaagtttcagctgatcctactgccatactcacagcagcagaagaaagaaaggagaaggtgccaagtccacacctcagtcacctagtggttttgacatctggggatacgttgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcctaaaaaaaaaaaa

SEQ ID NO: 982 - DNA, 1162 bp, Homo sapiens
  CDS (95)..(766)
agtcttttgtgcagcaccctttaaagggtgactcgtcccacttgtgttctctctcctggtgcagagttgcaagcaagtttatcggagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaatcttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaaaaaaaaaaa

SEQ ID NO: 983 - DNA, 2943 bp, Homo sapiens
  CDS (224)..(2227)
  misc_feature (1)...(2943): n = a,t,c or g
tgacgtcgttcaatggacttcttgcaatatcgctaagtattatgtctcatacatacctgtcgactaatatctacttttctcncagtggannctttgaatttgtagtcgtcgccagcagcaccggacccggattcccgggtcgacccacgcgttcgcaaaggagctattgaaggtcggagatttctccctttgtgctgggccctaccaaaatacagcagacaccatggaaaacctcagtaaagagcctttggcctcctttgtttcagaatcctttgatatttctgcttgtggaatagccacagagcacgtaaaaattgataacagtggggaggggctcacggctgaggctggttctgaaaccctaagcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaataatggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaaaaaaaaaaa

SEQ ID NO: 984 - DNA, 1773 bp, Homo sapiens
  CDS (235)..(1365)
gtacgcggtccggaattcccgggtcgacgatttcgtccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccactttcctatttccctacccctcccactactttcaatgatgaaataccctaagttaagttctccttttgacactttattgcgtagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaataaaaaaaaaaaa

SEQ ID NO: 985 - DNA, 2077 bp, Homo sapiens
  CDS (287)..(1912)
cctgcacgaattcggcacgagcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagcctacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctaaaaaaaaaaaa

SEQ ID NO: 986 - DNA, 708 bp, Homo sapiens
  CDS (46)..(708)
cgcacgagcttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccgtcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctga

SEQ ID NO: 987 - DNA, 668 bp, Homo sapiens
  CDS (340)..(654)
ctttcccgtttcgtagccgtttccgtcaactgtgaggaaagttatgaatactcgctggcaacaggccgggcaaaaggtaaagcctggtttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgctaataaactggcacagcgttataaaaggtgaggggagtttcgcaaaaattgttaaatctcaggcgtataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtcagggcaagcaaaagagatccttagcgagatgggatatacccacgttgagaacgccggtggcctgaaagacatcgcaatgccgaaggtcaaaggttaaagaattcctgcaga

SEQ ID NO: 988 - DNA, 1794 bp, Homo sapiens
  CDS (164)..(1261)
aattaatacgacgtcactatagggaatttggccctcgaggccaagaattcggcacgaggctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaaaaaaa

SEQ ID NO: 989 - DNA, 2342 bp, Homo sapiens
  CDS (881)..(2122)
aattcccggttcgacgatttcgtcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaacgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcaaaaaaaaaaaa

SEQ ID NO: 990 - DNA, 1327 bp, Homo sapiens
  CDS (158)..(856)
gcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagtaagtatatttaggtctacccagcatttgcatagtagtgtgcatcttggaacctggagcagaagcacaagatttcacacgtgtgatgtggtgtggatgaccaggaacggcttgtgatctgtggccgccactggtccagtaccactggtcaagatgggagaatctctccaaaaacaatatgctgttacactgacaacgttatgacaaaagttacatcaagttttcatggaatcagtcatccatgattttgcaccttaccacatgaattatttttggtttttttccattcttccaggctatgtatacttactttttccattatgagaatccttgtatagattaaacttggtgttctgtggatcatgtaaagttttcatgtggacacacatagtccttacagagtgtatagtatcctgtagaattgctatccagtaagaaggctgtgcaggggtggacaacatccaagcacctgaag

SEQ ID NO: 991 - DNA, 759 bp, Homo sapiens
  CDS (174)..(578)
ccttgtctcctgcgctaccggtccggaattcccgggtcgacccacgcgtccggctggatcaattctcataggagccacagcgcggagactgtgaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctgcataccatcatctaagctcctgtatcagcactcctcatcatcactcatctgccaagctcctcaatcatagccaagatcccatccctccatgtactctgggtgtcagcatctgtcctcttcagtctctataccccttccacttgcctgagctgaagtgccttgtgaagcctgcaataaactgctttgcaaattcatc

SEQ ID NO: 992 - DNA, 1854 bp, Homo sapiens
  CDS (559)..(1710)
  misc_feature (1)...(1854): n = a,t,c or g
atctctactagaaatacaaaattagctgggcacggtggcacatgcctgtaatcccagcactttgggaggccaaggcaggtggatcacctgaggttgggcgtttgagaccagcctgaccaacatggagaaaccctgtctctactaaaaacacaaaattagccgggcgtagtggcacatgcctgtaatcccagctacttgggaggctgaggcaggagaattgcttgaacccgggaggcagaggttgctgtgagctgagattgcgccactgcactccagcttgggcaacgagagcaaaactccatctctaaaaaaaaaacaaatgacattccttaagggccagggacctttattgtttagtcccaacatatttggggatttgggggcgatagccctactttgaattgaaaacaatttgagggttaactgcttgcaaactgtcatgggtctcagtctccaacctctgtggactgtaggggagtcaggcaccatttggcctcctccccagctctgtgatgtgctgcttctctagactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtaagtgagcacatttgggaagtactgttatttaaccttgacaaggtgactccgggctgaaatttgccacaggctaagctgatcttttacttcccccaccagagaagttagttctcatccgtcccggtccctgctgccactatgtactggttctcttggagttcaagtcggacgcgtgggtcgacgtnaattccggagagggac

SEQ ID NO: 993 - DNA, 357 bp, Homo sapiens
  CDS (158)..(355)
agaatgttggcttagtgcccagggttccctctcaccctaaccctctccccggtggggcgaggggactgaccgagcgcgttgatagcatttgtaggccggataaggcgttcacgccgcatccggcactctttcagcaacatggttagcggaggccaagatgtttgattcactggcaaaagccggaaaatatttaggtcaggcggcgaagctgatgattggtatgcctgattacgacaactatgtcgaacatatgcgggttaaccatcccgatcaaacgccgatgacctacgaagagtttttccgtgagcggcaggacgcgcgctacggtggaaaaggcggcgcgcgctgctgctaaat

SEQ ID NO: 994 - DNA, 437 bp, Homo sapiens
  CDS (275)..(424)
ctttgatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcggtgcgctctacggattgcccggcgcgatagagatcgctgcctaagcccgcccctgcacaacctgcgtctatccactgcgccaggttttctggcgtcacgccgccaacggcaaagactgcgatgtccgatggcaataccgcttttaacgctttgatgtattgcggaccaaaagccgatgacggaaatattttcagcgcctgcgcgcccgcttcgagcgcggtaaaggcttcggtctccgtcgcgcagccggggcaggcggtcatcccgtagccccccgcccggc

SEQ ID NO: 995 - DNA, 1714 bp, Homo sapiens
  CDS (147)..(1136)
accggaccggaattcccgggtcgacgatttcgtccaaggagtgccccggatgtgcccagctggcttctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggccccccttgtgcagagccaggggtctgagggcacctggctgtgttcccagctgagggagggctggggcgggggccgggcttggaacgatgtacgataccctcatagtgaccattaaacctgatcctcccccgc

SEQ ID NO: 996 - DNA, 1793 bp, Homo sapiens
  CDS (142)..(1017)
  misc_feature (1)...(1793): n = a,t,c or g
ggatgtctgtcgtcgcatgcacgcgtacgtaagcttggatcctctagagcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtatttnctactagangtagttttnctactttncatttagaacagagtatgagtcttaatctgaagtctttttcatgcccttgttttaaaaaaactacttttttcggcctcaaaaaaaatcaagggtggtaatttttnaataaattgtttaatcccattggtgttgnaaa

SEQ ID NO: 997 - DNA, 1679 bp, Homo sapiens
  CDS (521)..(1330)
  misc_feature (1)...(1679): n = a,t,c or g
atagaaccctgtagtactggtccggaattcccgggtcgacccacgcgtccggcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggtgagagccagtgtcccctcaaatggtggctgggacaggttcctctgcgtgggtgtctgcctagaccagatttagagaccaacttgaattgctgggctctgggtttctttgaagtctgtctttccctcacctctcaaagaaaacagaatgtactgggagcctttttcttcttcctggcatccctacagcatctctcaccaaagattctagccacatcaagcctgtttccaaggccttgacccanctgcataagtaaccaacatgcatgcacctagcgggcgaggcacagccggacgcgtgggtcgacccgggaattccggcccgggacctcaagcgtacggcttcaaactctg

SEQ ID NO: 998 - DNA, 3623 bp, Homo sapiens
  CDS (76)..(2904)
  misc_feature (1)...(3623): n = a,t,c or g
tggggaaannncctgatcgcctcggtaccggcccggaattcccgggtcgacccacgcgtccgcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatataggttcctgataaa

SEQ ID NO: 999 - DNA, 2093 bp, Homo sapiens
  CDS (270)..(2093)
ttatccccccccccccccccccccgctctcccttgacccctttctctcctttgctctctttctttctctctcccttttttttcctttttccctctctttcccactccctccccaccccttcccttcctctcccctcccccttcccctccccctcccccgggcgcgagcctttttctctcccctcctcccgctggcggctgtttccctctccctccgtatccttgtccctctcagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagcccgtggaaggaagatatctatgaggcaaagcagaggagagctgataaagcgaggagtgctggagggaaatcatgatagagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagccagaggctgcagccctcaccagacagccaaacctgccagcgccttgatcttggactttccagccccgacaactgttgcaatgagctatttaaaaagaagaagaagaagaaggaggaggagaagaagaagaaggaggaggaggaggagaaaaagaggaggaggaggaggaggaaagagaagagaagagaagagaagagaagagaagagaagagaagagaagagaagagaagagaaaaggacatttggcaatgtctgaagattgttttggctgtcacagttggaggaagtgctgctggcatctgctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccagctctgctacagtacaaggagagccccaggtatgtgaggggcaaatgaagatttatctgcagatgggagtgagatgccagagcatctggctgccccagtga

SEQ ID NO: 1000 - DNA, 852 bp, Homo sapiens
  CDS (1)..(372)
atgctgtcctccagcctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagaaaaaaaaaaaaaggggcggccgttttagaggatccaagttaacgaacgcgggcatgcagacgaatagtttttttataggggccccaaaattcaattcacggcccgcggtttaacaacgtcgggacgtgaaaaaccctggg

SEQ ID NO: 1001 - DNA, 1392 bp, Homo sapiens
  CDS (187)..(903)
  misc_feature (1)...(1392): n = a,t,c or g
ctttgggcaggatcccatcgattcgaattcggcacgaggacaggaggaagaaacaagtataaaggttttggttttggaaagaagttggaatctccagaccctgggaccttaagatccacagaattgctgaaagaaaaagtactaccttattgaaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttatnctttgagaatgttaccttactgtttgtaatagtgctacatttttctgctttcatggcctctgtattttcacaaaacaccaaaaacagcatttaattatattatccatgagtgtgtttctggacacaaacttctggcagtaggatggacc

SEQ ID NO: 1002 - DNA, 2085 bp, Homo sapiens
  CDS (202)..(987)
aatttaggtgacactatagaagagctatgacgtcgcatgcacgcgtacgtaagcttggatcctctagagcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccaaaaaaaaaaaa

SEQ ID NO: 1003 - DNA, 2278 bp, Homo sapiens
  CDS (84)..(1010)
cggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcata

SEQ ID NO: 1004 - DNA, 1923 bp, Homo sapiens
  CDS (253)..(1671)
gctggtcctcctgcaggtaccggtccggaattcccgggtcgacgatttcgtggacagacagatagtgggacttctcagggcttggacaagccccaccccacgcttggggtggggtccaggactacagtgcccgcccagtttgcggacagtgaaaaaaaaaaagtaccgttccaaagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaaaaggaggaggaggag

SEQ ID NO: 1005 - DNA, 1410 bp, Homo sapiens
  CDS (608)..(769)
atttggccctcgagcacgagattcggcacgagctttcctttctgcttagagccgtaggcagggaagctggaatctgttatggtgtattacggggaggagcctttctgttatttccccccagcttccatcacccttcccttaatgccaggagcgccgaggtttggaactgaggctaaaccgaaggctttctcctgcttctgtcaccctgtgctgtctcccggcatctcctcactatctgggtccaggcccgggtcctccctgcagactccctcccctccagcccacaaggactccagcctgctggctggtgagagctggatgagcagtaagaagttaacgccaggtcagcctcgggccccagggttccctgggcacaggctgacactaggagctgctctccttggccggggacagctccagcagctcaggctccagccctccagtgagccgcctctcctggagagtagcaaagaatggagaaaggcctggcttgagaggaaatggagaaaacattgcctggtagctgcagattcaaacccaccacacacaccacggggctagagtgactcacctgggctcacaccaacttctggccaatgcagggaccatgctctgcagacagcagtcctctagcatggccccagcattcagccagtcggtcacctgtgggccatccccatgtgtgaggaagcaggagtcagccaccaagtgtctccacatcggagcttgcgggtcagacctgtgggccaggggatgggagcagggctgagggtaggggctgaatgtgtggctctgtccctgtgttgccttccacagaggagcaaggcctcaggctgaggaaggaggggcacgctggaacagcctagtctcctccccgtggattcccccaaacccataacattcttccataggggctgagaacgcagtgccccgtccctgacagggatgaaaagtgaacccctcaggtcaggagaggcagagttgaggttctgccacttcctgtccctggggagccactcaagttaccagggctaccggctgaaataaatcttttccgggtagggtcaagggcagtgtgttccaaggcaactgatgtaggccagttgcgtgactccaggtttgtcctggtactcagtgggtccaatcacctggcattgatcacctggcattgatcagcacccaccccacccctgaggcttgcccagcccccaggccctcagatccctgctcttcctgcctttcctgcccatgtgtcacccagcacccaaggttcagtgacacagggtggtttggagctggtcactgtcatagcagctgtgatttcacaaggaagggtgctgcagggggacctggttgatggggagtgggaaggggaaggaataaagagatcttcctcaggtaaaaaaaaaa

SEQ ID NO: 1006 - DNA, 2142 bp, Homo sapiens
  CDS (528)..(1604)
tacgcctgcaggtaccggtccggaattcccgggtcgacccacgcgtccgctccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcttctggaggctgggaagtccaagatcaaggcgtcagaagattcattgtctgtccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcctccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaaa

SEQ ID NO: 1007 - DNA, 2351 bp, Homo sapiens
  CDS (356)..(1924)
cggccccttgaacccatcgataccgctccggaattcccgggtcgacccacgcgtccgggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggcccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttaaaaaaaaaaaa

SEQ ID NO: 1008 - DNA, 2243 bp, Homo sapiens
  CDS (356)..(1816)
cggccccttgaacccatcgataccgctccggaattcccgggtcgacccacgcgtccgggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggcccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttaaaaaaaaaaaa

SEQ ID NO: 1009 - DNA, 2210 bp, Homo sapiens
  CDS (356)..(1783)
cggccccttgaacccatcgataccgctccggaattcccgggtcgacccacgcgtccgggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggcccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttaaaaaaaaaaaa

SEQ ID NO: 1010 - DNA, 1233 bp, Homo sapiens
  CDS (122)..(733)
aggggtggttttaactgaagcctggatgacataactatctattcgatgatgaagataccccaccaaacccaaaaaaagagatctctcgaggatccgaattcgcggccgcgtcgacccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaaaaaaaa

SEQ ID NO: 1011 - DNA, 828 bp, Homo sapiens
  CDS (45)..(809)
  misc_feature (1)...(828): n = a,t,c or g
attcgagaccattagttggngngcttgaattcgctcgcggggccatgccattcctcgggcaggactggcggtccccggggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccagggtaagcgggcaggcccagcctcctcccggcagtgggtccctccacagggatactggacagcctcgccaagactttgaattcactcctgtgacggaagagtctggtcttttctgatctgctgccttgttctggt

SEQ ID NO: 1012 - DNA, 1823 bp, Homo sapiens
  CDS (164)..(1786)
gcacgcaccggtccggaattcccgggtcgacgatttcgtccggggtcctgggccccgggcggcggtcgccaggtcttagggtcgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttccccccaaaaaaaaaaaaaa

SEQ ID NO: 1013 - DNA, 828 bp, Homo sapiens
  CDS (202)..(501)
atctagcttatatacgactcactatagggaccactttgtacaagaaagctgggtacgcgtaagcttgtgcccctcgagggatactctagagcggccgctcgcgctctagatgacagtcaataaaaatgtagattagataaactgcatctattacacccaacagcaatgagcttttcatgagttgaaaaaaagaaaaaacccatgtcggccccagccctggggctacctgacctgacaaaaccttttacactctatgtgtcagaaagagaaaaagtggcagttggagttttaacccagactgtagggccctggccaaggccagtggcctatctctcaaaacaactagatgaggtttccaaacgctggcccccatgtccaaagtccctggtagcaatagccctgttagcacaagaagcagataagctaactcttagacaaaacctaaacataaagtccccctgtgctgtggtgattttaataaataccaaaggacaccattagctaatgaatgctagactagctagataccaaagcttgctctgtgaacatccccgcataaccattgaagtttgcaacacctaaaccccgccaccttcctcccggtgtcagagagcccagttaaacataactgtgtagaggtattggactcagtttattctagtgggcctaaccaccgagaccatccttaaacatcagtagactgggagctgtacatggatgggagcagcttcaccaacccctgcaaagtgactctgaagaagacgacaagccctgctccagtcacacccggaagctgagtgggtcacgcacagctggagcatgaggaaa

SEQ ID NO: 1014 - DNA, 2550 bp, Homo sapiens
  CDS (106)..(2172)
taagcttggaccgacgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactg

SEQ ID NO: 1015 - DNA, 2521 bp, Homo sapiens
  CDS (106)..(2094)
taagcttggaccgacgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactgttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccaaaaaaaaaaaa

SEQ ID NO: 1016 - DNA, 1729 bp, Homo sapiens
  CDS (247)..(1371)
ccggaattcccgggtcgacgatttcgtgcctggtccaggtggcccaggctgggggcatcgcctcgaatgacacccaccgccctcaggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaaggtaggcgactgtacctctcttgtcctggaatgggcgatggctgggagaagtgaccaggccccaactctctctccagcctcgcctgattctctaagacttgccagcccttctcctgacccctgcaccgcctcctccaccttcgttcattcagcaagaatgaactgggctggggtgaaggaactctgcaggggcaggaggagaggacaaaggaaggaaaccaacttcatcagtgttactccagtggcttctgacacacagaaggggactgtcatagtcatgcttgatctcatgctcattcttttaccccctagtgcctccatactgagaggtacacacgggtgaacacgcacacacagacatgaacaggacacgaaagcaaagcacaggaacaagctctggctcattcacagaatcatttattcacaaatgtattgagtgccatgcaccaggcatgttttagggctgaggagatggcactgaacacaatggttatggcccctgtcctcatgaagtttatagtctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtgtattgcggccgctctagaggatccaagcttacgt

SEQ ID NO: 1017 - DNA, 1970 bp, Homo sapiens
  CDS (194)..(1402)
  misc_feature (1)...(1970): n = a,t,c or g
gctgccgcggtccttaattcccgggtcgacgatttcgtctttctgcgggcctttccggtacttgagcggtgttcagagcgtggccagttctcgtctatctggctgcctttagggagcggtgcctagcgttggccaatagttggctgtcgaaagtgccggcccccgcgccggcgcctgcagcagtcgggtgggaatgctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttaggtgagtgggtcatctggaattttcccagctcccccaggaaaatgtanggcacngggtatagcaccccttatggttacctaaagccccggncctaaccactggaacnccaggttcntggatgg

SEQ ID NO: 1018 - DNA, 1432 bp, Homo sapiens
  CDS (854)..(1330)
  misc_feature (1)...(1432): n = a,t,c or g
cacgagggctgtcctggagtgatccttggagtaaaggaaaggtgctttgaagcacattcagccatcagccctgtgggatggcagccactgatttgtcctatgggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctgcttcaaggactgagtccctagtcgaattcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagtgagtgtggataaagaggacctcctggggtgggcaatgtgagccctcagactctgtaggtattgcattttgcagtgaacactggtagacatgttttgtggctcaagccagcatgtgtgtgatggtttaggattcagtgacttttgatgatctggctgtggacttcaccccaaaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagaagaaccgttgcacaaggaagaagaaagctttttgattgcagttgactctggggaaatccttccattaatccattcacaccttccagggacatttaagaactccacnatgggagaaagtctcccatggaaatgggaag

SEQ ID NO: 1019 - DNA, 1477 bp, Homo sapiens
  CDS (67)..(753)
  misc_feature (1)...(1477): n = a,t,c or g
atgaataaaaggttatttgagccaaattacaggaatgtgtaatacttgagggttagctggagaacaatgaccaggtattgggagggctggtctcaacacatttcactcttcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatttcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggttgacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggattctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaaactggaaggaactggacctcttctccttttcctgtgacctttnaacctttagtctgttcaagggaaaacccttagggacctttgaatcaagagggattgagtttgtggggtgaacntggaaggtggtctttctgttacaggggcctgggg

SEQ ID NO: 1020 - DNA, 3324 bp, Homo sapiens
  CDS (168)..(1625)
ccattggataccgttccggaattcccgggtcgacccacgcgtccgcccacgcgtccggtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacttggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcggctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtgtcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacccggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaaaaaaaaaa

SEQ ID NO: 1021 - DNA, 1497 bp, Homo sapiens
  CDS (79)..(762)
gatttcccgggtcgacccacgcgtccggtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaggaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaagtcgacgcggccgcgaattcggatcctcgagagatctctttttttgggtttggtggggtatcttcatcatcgaatagatagttaatcatcacgcgtcgaag

SEQ ID NO: 1022 - DNA, 1173 bp, Homo sapiens
  CDS (41)..(1084)
atttggccctcgaggccaagaattcggcacgaggggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaggagcagaactgcctagcatcgagcctggagagtttct

SEQ ID NO: 1023 - DNA, 2412 bp, Homo sapiens
  CDS (158)..(544)
gagggccgaccgccatggaggtaccgggtcgacgatttcgtgggttcaccatttcttggggcacacttgatttaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagagtcttgctctgtgcccaggctggagcgcaatggtgtgaacttggctcaccgcaacctccacctcctggattcaagcgattcttgtgcctatccccaacaccagcaccatacctggcacacggtgatcattcaacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgcagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatattgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattaaaaaaaaaa

SEQ ID NO: 1024 - DNA, 1471 bp, Homo sapiens
  CDS (179)..(1180)
ctgcggtaccggtccggaattcccgggtcgacccacgcgtccggacgtgttctgccagcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccataaatacctttgggctgcctgggacaggctccttaggaggattgagggtgaaagtttcccccgagtaccctaaacctaggtttggtccccaatagggtttggaaagcaaagggccccaactcttcaccaaaaaaaaaaaa

SEQ ID NO: 1025 - DNA, 1369 bp, Homo sapiens
  CDS (179)..(1078)
ctgcggtaccggtccggaattcccgggtcgacccacgcgtccggacgtgttctgccagcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccataaatacctttgggctgcctgggacaggctccttaggaggattgagggtgaaagtttcccccgagtaccctaaacctaggtttggtccccaatagggtttggaaagcaaagggccccaactcttcaccaaaaaaaaaaaa

SEQ ID NO: 1026 - DNA, 1380 bp, Homo sapiens
  CDS (148)..(1131)
ccttggtacgcccgcaggtaccggtccggaattcccgggtcgacccacgcgtccggtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggatgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaaaaaaaaaaa

SEQ ID NO: 1027 - DNA, 1227 bp, Homo sapiens
  CDS (148)..(978)
ccttggtacgcccgcaggtaccggtccggaattcccgggtcgacccacgcgtccggtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaaaaaaaaaaa

SEQ ID NO: 1028 - DNA, 1457 bp, Homo sapiens
  CDS (227)..(499)
tctttaatgtaatatctaggagataatttgttactaatcaataattataaatgtcataacaaatattaattttaagaacctatacttttattgaaatgtatcttgtttttaggtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagatatagctctacggttttacaggcggctgctgcatatgggcatttataacggccagctttttaacaatctggggctgtgttgcttctatgcccagcagtatgatatgactctgacctcatttgaacgtgccctttctttggctgaaaatgatgaataggcagctgatgtctggtactacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcaaaaaaaaaaaaaaa

SEQ ID NO: 1029 - DNA, 2375 bp, Homo sapiens
  CDS (63)..(1388)
taccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactg

SEQ ID NO: 1030 - DNA, 455 bp, Homo sapiens
  CDS (96)..(236)
  misc_feature (1)...(455): n = a,t,c or g
ccggaattttgaggtcgttccacgcgtccgcccacgcgtncgcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaatgggctgctgctcctgctgccctgtgggctgtgccaagtgtgcccagggctgcatctgcaaagggacgtcagacaagtgcagctgctgtgcctgatgccaagacagctgtgct

SEQ ID NO: 1031 - DNA, 922 bp, Homo sapiens
  CDS (26)..(520)
ggaattccgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctggtgg

SEQ ID NO: 1032 - DNA, 1501 bp, Homo sapiens
  CDS (161)..(1468)
ggaagacatcctgagcgatgaggtcaacgtggcttgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaaatcccatcaataaaggaaaaaacaaaccaaaaa

SEQ ID NO: 1033 - DNA, 1626 bp, Homo sapiens
  CDS (160)..(1497)
taagcttgcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgcttttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaa

SEQ ID NO: 1034 - DNA, 2576 bp, Homo sapiens
  CDS (120)..(2024)
ttccctacgccacgatttcccgggtcgacccacgcgtccggcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcaaaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaaaaaaaaaaaa

SEQ ID NO: 1035 - DNA, 1230 bp, Homo sapiens
  CDS (119)..(1198)
ccctgatagccgtacgcctgcactaccggtccggaattcccgggtcgacccacgcgtccggcggcggcggcggccggacccagactggtagtgaggcgttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggacaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctctgaaaaaaaaaaaa

SEQ ID NO: 1036 - DNA, 2117 bp, Homo sapiens
  CDS (172)..(1095)
atttgcacatcgattcgatgatgaagataccccaccaaacccaaaaaaagagatctctcgaggatccgaattcgcggccgcgtcgacggaatcccatctggagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgacctgaactcatatttaaactctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtaaaaatgggtcatttttatttttaatgaaaagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacccaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaaaaaaaaaaaaaa

SEQ ID NO: 1037 - DNA, 2014 bp, Homo sapiens
  CDS (158)..(1717)
tcggctctgcaggaattcggcacgagttccttgtggctggagcgcttcccgtagcctcggggaaggagcaggatttataggaccactaagaggaccccatcctcgtgctggaggaacaggaacctctttcacgagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcacgagagcaggatcctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccaggcacggttcaaagtttaagagcatttaggccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactcccacttttcttttaaaaaaaaaaaaaaaaa

SEQ ID NO: 1038 - DNA, 2213 bp, Homo sapiens
  CDS (115)..(1233)
ttcgtgtggtggaattcgaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagagtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcggtcagtactaacatagcatttcgttacctcttaagggttgtgtttacaactccaaattcaagcatttcatctcaagagttgtagaagtttattacaacctcacttcagtatacttttcaaagtaatgaagtagcatcatcacattataaattagagtacctatacaaggcttttttttttccccagcatttccaaaactacctagtcccattgctttaaatcgtatctgtaccaagtgttggcaaactatgaaccacaggccaattccagcctaccacctttatttgtaaatcaagtattactggaacacaaccaggctcatttgctgacatattgtttgtggatggcagagttgagtggttgaaacagactgtatggtgtgcaaagtcagaatgtgtgctgtacggactgctgtgaaaaacatctgccaaagtctgatctgtatacccataactccctcctgcttgatatttcccataaatgtataaagggcatttcacatttaacaaggccaagacagaactcttgatttctaactccttgtctgaatcctgcttctccagcctttctcccatttcagtaagcatcatcattatcccctaatttctcaagcaaaatctctgaggattgttcttaatcttttttccttaccactcttcatctccctcgtagttaatccttaagtcctgtcaactctgcctataaaatatatccctgtctacttttctaatctgtactgtagccaccctactctaagtcaccaccatcttttgccttgactactgcaataaccttcaaagtagcctctgattgcattcttcccctaatccattttccatgtagcagccaaaatcatcttttcttttttaattaagtcagattatgtcactgttttaagctatagattcttaacattctttattcatacctaaaatctataggccttgctatgccttctaaagccctacacgatatgacttctgcctaatccgtcac

SEQ ID NO: 1039 - DNA, 2484 bp, Homo sapiens
  CDS (305)..(1387)
agctacagctttaggataggcctatttaggtgacactatagaacaagtttgtacaaaaaagcaggctggtaccggtccggaattcccgggatcggcgacgaaggcggtggccgtgcgagcgcaggactgggcggcctgtgtgggggtgtgagccgcggtgcccaaggctgcgccggcgaggggaagccgcgcggccggccggccgactagggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttataaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaaaaaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattcttaaagtctgaatgcttagaacaaacttaacatgtttatagaatatggtctctttgtaccaagtactttgcttaagagctcctttgggccactacatattttggtttctagaaaatgtttgtttgtttatgaagaagttgatggaaaactgcaaacatatgcagaaaaggtagaataataaaaaaggtctaatgaactccaaaaaaaaaaaa

SEQ ID NO: 1040 - DNA, 4202 bp, Homo sapiens
  CDS (217)..(3408)
gatcgcgccgcacgatttcgtctggacagctccagccgtgtcctgaggagctggaccagccacatcccctggggctgcagttgaagcagaaccaagtggccatcccggcgttagaccgtaggttcctggtcccggagtggtcggagcccgccagtgggcaggcagctcttgctcacaggccgcggtgcccaggccgctggctctccgcagggcggaatggcgctgcaagtggagctggtacccaccggggagatcatccgcgtggttcatccccacaggccctgcaagcttgccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggccttgccatatgcaattgcatatggcaaggccaagtggaggatgagagggcggtgtcccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggggcggggccctcacctgctcaaactcgtcagtgatggtcttgggctcctcgtgcctctggaaccacatcatgtacttggtgtggaatcgccatgactgttctttagggcc

SEQ ID NO: 1041 - DNA, 1616 bp, Homo sapiens
  CDS (184)..(1503)
catcctgattacgccaagctctaatacgactcatatagggaaagctggtacgcctgcaggtaccggtccggaattcccgggtcgacccacgcgtccgctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaatatcagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaagaaaaaaaaaaaa

SEQ ID NO: 1042 - DNA, 1696 bp, Homo sapiens
  CDS (167)..(1405)
atgagctaacattaaacatagccataacattcaagtcatcaatcttttcgtagtcataatcctggtctatcagagaaatcaccacaatccatttaaatgaatttgataatcattctcgtttggcatagcatgaaacatagcaaaggctatgttttagaggcacaagatgacgaactatcgcgttgagagtagcagcggacgggcggcgcgcaagatgaggctcgcattaatgggacctgcgttcattgcggcgattggttatatcgatcccggtaactttgcgaccaatattcaggcgggtgctagcttcggctatcagctactgtgggttgtcgtttgggccaacctgatggcgatgctgattcagatcctctctgccaaactagggattgccaccggtaaaaatctggcggagcagattcgcgatcactatccgcgtcccgtagtgtggttctattgggttcaggcagaaattattgcgatggcaaccgacctggcggaatttattggtgcggcgatcggttttaaactcattcttggtgtttcgttgttgcagggcgcggtgctgacggggatcgcgactttcctgattttaatgctgcaacgtcgcgggcaaaaaccgctggagaaagtgattggcgggttactgttgtttgttgccgcggcttacattgtcgagttgattttctcccagcctaacctggcgcagctgggtaaaggaatggtgatcccgagtttacctacttcggaagcggtcttcctggcagcaggcgtgttaggggcgacgattatgccgcatgtgatttatttgcactcctcgctcactcagcatttacatggcggttcgcgtcaacaacgttattccgccaccaaatgggatgtggctatcgccatgactattgccggttttgtcaatctggcgatgatggctacagctgcggcggcgttccacttttccggtcatactggtgttgccgatcttgatgaggcttatctgacgctgcaaccgctgttaagccacgctgcggcaacggtctttggattaagcctggttgctgcggggctgtcttcaacggtggtggggacactggcggggcaggtggtgatgcagggcttcattcgctttcatatcccgctgtgggtgcgtcgtacagtcaccatgttgccgtcatttattgtcattctgatgggattagatccgacacggattctggttatgagtcaggtactgttaagttttggtatcgctctggcgctggttccactgctgattttcaccagtgacagcaagttgatgggcgatctggtgaacagcaaacgcgtaaaacagacaggctgggtgattgtggtgctggtcgtggcgctgaatatctggttgttggtggggacggcgctgggattgtagttgaatgagcgtcgcatctggcactattggcggatgcggcgtaaacgccttatccgccctacgcgttaaagagccggtttgtaggcctgataagacgcactagcgtcgcatcaggcattgtgctccattggcggacgcgtttaatggcggtgcccatgaccccggccttttccgcgatgatcgtcacgatcgcgccagccttcacgatagccacgctcatacgctttacgcttatcccagccacggtggtagccattatcatgacgccaccaacggtttttgcgccactcc

SEQ ID NO: 1043 - DNA, 771 bp, Homo sapiens
  CDS (4)..(462)
aggatgatgtatataactatctattcgatgatgaagataccccaccaaacccaaaaaaagagatctctcgaggatccgaattcgcggccgcgtcgacctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctcctaaaaaaaaagtcgacgcggccgcgaattcggatcctcgagagatctctttttttgggtttggtggggtatcttcatcatcgaatagatagttatatacatcagcccttcgatgggagagggaacc

SEQ ID NO: 1044 - DNA, 2525 bp, Homo sapiens
  CDS (237)..(887)
tcgcctgcggcaccggtccggaattcccgggtcgacccacgcgtccgcccggggcaggagggcagccgcggccggcaggacaggcagacggacaggctgacaggagagagaacaggcactgcgggacctgcaggagaaaggcgatcctgtggctgggaatgtgaccccacggccagaagaggacccggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgtccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaaggtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctgtggttgttttctgagccaagcattcaatatcatgccccac

SEQ ID NO: 1045 - DNA, 2900 bp, Homo sapiens
  CDS (123)..(2504)
ggtgacactatagaacaagtttgtacaaaaaagcaggctggtaccggtccggaattcccgggatcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcaacgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgaaaaaaaaaaaa

SEQ ID NO: 1046 - DNA, 2225 bp, Homo sapiens
  CDS (260)..(1906)
ttggacgcctgctgtaccggtccggaattcccgggtcgacccacgcgtccgggaacagggagcagacgttctgcaagtagggagcacttcatgagtggcaagtgtggtgtctctggtggtgttccaacggacactccctctggaatgtcatgagaattaaaaactggggcataagggaagaagatggctgagaatggagcctcggtttctatgtctgtaaaacaactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatcataaaaaaaaaaaaa

SEQ ID NO: 1047 - DNA, 2562 bp, Homo sapiens
  CDS (314)..(1777)
  misc_feature (1)...(2562): n = a,t,c or g
aatgtgtgtgctgctactaataagtctgtaatgacgatcttgtatgtattgcttgctacattcatgctggaaggattaagtgtgatggagatttgaantcctnnattggaagccttcggtaccggtccggaattcccgggtcgacccacgcgtccgaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagctggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccaggtgagcgaaagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccaaaaaaaaaaaa

SEQ ID NO: 1048 - DNA, 8312 bp, Homo sapiens
  CDS (6633)..(7064)
atttttttttattttaaaaagttttattttggagatttagaaatttgagatttttaataacggcaaaagaaattcagtcacacctaatgattaacagaatgtagtggtgtattatttaaacagaaatcgtgctgatgtgtcataataaattgtctattagtaaaaaaatacactttagggcacagcattgtatcacaaattacagtagggatactttgcaagaatttaatcaaactagagaattctgagtaactgtatcttttaaatgcagcacttaaaaatgtaacaactctgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaatgtgttttcatgtacagtaagtcattgtcttcacttcaccctcccccagttgtaaatctccttgctgtacatttctgttaaatccacaacactggttatatattccaggtgcatttaaaaaatgtgtgcatattacttcatgcataataaaataaaatgtgtacgtatgctaggccagggccatagtaaagtttgaaacagtgtactttggaaagaacagacctcaaatgcacccccatttactggctggtattttaacggaaatcaatatgtgaagttaagcagtgacgataaaaaaattacaaaaatcacaaagcaaaatatctttgaacctctagccaataccaacagtcccgtcaatcacaaacatgcagtgtgtagcatgttttccgaccatggttcaggggcatgctcactcatctttatcagttcaaacaaatgcctcatactaacaaactgtagtatcaactctaaaaaaggtataatacttgatagagtggttccatttagattaagtttaatccagtttcacattatttaagttcctatatttcaagagttaaaagtggtcaataaggacagaaacacagtttgctccaacgagataatttggatctccgggaagacacttgttttgccaggttttaggatcacagtgtggtaagcgcagctccacaggcttcaggaacttgaggccatggggaccacacatcaccaaaggactcagcagtgtttcacctttctctttatctaaaggtggaaggatgctgttgtcccggcagaccttgaaatagatttcctgctcaactccttcgggaatggctccttgagggataattatactaacaccagtttctatggaactcagcacgcccccattgctgttaaatatgcctcgggctgtggccaccacagtatgaccatcttcatcttcatcctcttccacagctgaaggactcacaggaatagctttaggcactgtgctgatattatttatttgatatttaggcttctctgcatggatagagaaagtttcaactccactgtcaaactcaggaggctgtgccaaactgtgcgatttcacaagagtttttggagaagtgggagtttttgaagacaagtcaggtttatgtgcagtttcacttggcagaagattgtgattgaatttaggactttcaaacttgcgttcaaatggtcgggcagaacttgtatatggttttggtgtgaatcgattgtatgctggagtgactgttttctgagtctgttcagttccattaactggggctttatctggaaaacttttctggggatagaaagctgcctgagcagtatcttctcggtttggtggtctgaaagttgctggcttattctgagatggaggtgggtctggtttggacactaaggaattctgaaaatccaatgacactgaattaccttcaccatgtgctcccttagaatgtatgtggagagacgcgctggtgacaggctgagatggctgggcatactgcgagggcaatggaggaggagggggagtggcctggatgggttcatagcgtttctcgccaaatgatctatccacaccatcagcttcaggaggctttccctttgaagaataactagaaaaatttgattgattctgagaatgagctggctttgcaggctcggagagatggctggcagcaatgtgtgcaggaggcttattctcaaaacttcttcggtcaaagtatgacagctgttttcgataatattcttcatcttcttcagggtcataatgattggaccgaacaatatcttcaggtggcttcagttgaggtttttgaggttctgggatcctgtacagagttttgtcatgttcactgaattgattctgagaagtgggtttgggaccaatgatgggagcacctgaaggtttagatgctacttctggaggcttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggcttatgctgagatgaaggtatcagcggagggacagctgcagcaccatggagaggctcaaaatgacctgctctagaggtaaatccttggggtggtacttgctcgtaactgcgtgaatattgctcaaaatactgcttggactctgcaggcttgggccctgctgaagggtggggctgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggggacgcgatcttcgtatcgcagacgatgttcatagtttcgagaaaactggtccgtatagcttgaggactcgtatctgtatgtgggctgctcgaggtctctgctggcttgtttctctacgtatgggagttggggttcataggtcagattaggctctttgtctggcctgtgccctgggtgactaacggctggctgtttcaaaacatggttctgcctcatcatttcctcgggatatggatcctttctatacacctttgttggatctacatgcgacgacaatgatggttcttgatctcttagcattatgtgagctgcctcagtacttggtgttcttaaagaatcagcttgtggtgagtaagaggtggaaggagctggggtgggctcctccagtctgacattagttaaatttacattatgattaacagcagaggttgatgatgctgggtttgtttcaggcgaaaggtaagggactggagatgaagcttctgctttctgttgagaggctggcttaaatccaggggagtctattctatgaattggttgtggctgcgcttgtggtgagtaaggaggatatgtttggttttcatgatgcattccagaggagtcctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctttccctcggaaacccataccagctggttttgctgttgttgaactgcttctttcagcgcaccataccaaccatcattcattgaatttaagttaattgtagttgtaaaaagatggtgattatttttagcaagtttatgagatcgctcgtataacttcctggcacttttccgagattctggacataacctcattctcattgtttttactccttgcttagaatcagggttaagaaatacaacaattggataccactgggcatagttaagacgatcaactgcatttggtgttacatctaataaagcatgtttgtcttgatctatgatttgctttattgtatgcaggcgaatatagccagagctacgttggtcagttccagcgtctcgtggttcactctttgcaatttgataaatatctggttcttctcttgccagcttttctctggcaacatcagctattggtccaaaaatggttacaggcctcagaaatccagcttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctgttcttattagggatgatgcctcgttctacctccttatgatttttaccaattcgaatagcaagccaagagcccagttttccattgtacaaggtatccacagcacggaacacctctcctttgttaaaactaagtccatagggagattccttttcatattcaaaatgggttctaatatagaaagaatctcctacatctgattctacaatgcgacgataaacatccttcttcttctgagccaatatggtcacttcttctcctttagggaggtcaagcaggaaaaggacggcttcttctcttatgatatttgtaaaatctacgttgtttaccctgagaatttgatcaccttcctctaagccttccttggctgcagggctatcttctagaacgccagctacaaatattccaacatcatttccaccagccagccgcaaacccacactatctccttttctgaattttaccaatttcatgctgggccgaagaaatcccatcttcatgagttgaattaggtaggacaccatcagatggactgacaggtaaatccacatctggttgccaacttgggcatacacaggctttggttctggaagagaaggtgtttgtttctcatttctttcaactgtaacttcttccactgttttaggtgtgtgatcatcagcatgctttacaggagttgagacagccccaggtttagaaattctctcttcatctctactccggagactgccattgcttggctgctgcggcgagtgcctggaatgatcagaaggctctgaccgctggtcaggagatcgtgaccggctgcggcggggaggcctatcgtgtgatcgaccagaatgatctgatgccagtgactgaatttctgaaatgtcgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatcttcaatacaacatcaccttcttgaatattgccatctcttgctgccaaactatcttgtgaaatttccttaacaaatatatggcttgccaatcgaagaccatattcttcatttttccgggatttcaccagtgtgactttagtaggtttagcaggctggctggaagccactgaccgcctgtctgaccgcggggacaagctcctctctctacttgcacttctatccctcggccaaatcttctcactccttctgttaaccacaccactccggccacttcttggatcatgtatttcctcatcataactatcttcttcattatcagatactggttcaggatcaggacgacttactggtatttgaactttcttcttccttctaattgtaatttttgcatttttcccacttttccttagttgctgaacagcaaaagcatgttcaacattatccattgaaactccgttaaccattgcaactcggtcattttcctgtagctgtccttcagctggtcctcctttcagcacatctgaaatcactattgacgtttccccactctgaaaatgaggattatctcgtccaccagatattgcaattccaaatccaaatccaggagccctgtgaagcgtcactgtatgttgttcccatatagctgtttcctccattgctgtgctcttggcggccgcagctctggcggacatcttgtctctctccagcgccgcgcgaggctcctcggacccgaaactccgcggcgcaggcccgcccgctcctcacgccacagcccaaataaacatctcccgagagcgagcggggcacgggcgggggcggccggaagggcccggcccagggggagggaattcaactcggacaaaagtccgggaagcgcccgccccgcccgggtcttctccacggggcgcgcccgaccggcacctccctccgagcgcggccacccactcggcctcccgcagctttcgcagcccggccacgtcggcctcgcccggtcgcccgcccgtcagcagcacccgtggcctcccggcgtctcctcggaagccggcttcgccacgtaacttcccgggaaccggcggccgccaaggaacgcggcgtccgctggctcagccggcgccggcaactcagcggccacgcaaacctgccggcccggcccactgagcatgcccgttttgccggaggaacagccaagcctcccactgcctgtggggggctgcgaggacgggctgggggtgtccttccctggctgccccagcaactcccacgccttctgcccttggtctcactctaagcccaggtgggacggtcgtcctcctcagctaggcttcctgagctctgcagcgctgggtgggctgtggatgatggggggctctgttgacaggttctgcgttagacctgcatcttagcaatgtgaatattgcatccctagagaaggacctggaagagcaagacggccacgacctgggagcagcaggtgagggtggggaggacctggggccctgctcctccagccgctgaacagccaagtgctgtggccggaggatcgcttgagcccggggaggtcaaggctgcagtgagctgaggttgcaccactgcactcctgcctggaccacagggcaagacccggtgtctggttttcggagcgggaggatccccttctggcggtacctcctcctcctctccctgactgcctctccctttccctcccctgcacatggactcctcagcatctctcctgcctcgggcctgcccacttcttcagttgacctttgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtcca

SEQ ID NO: 1049 - DNA, 1610 bp, Homo sapiens
  CDS (153)..(926)
atttggccctcgaggccaagaattcggcacgcgtccggtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaa

SEQ ID NO: 1050 - DNA, 2555 bp, Homo sapiens
  CDS (439)..(2541)
atttgaagcccttttgagaggctctcggaccggaattcccgggccgacccacgcgtccgcggacgcgtgggcgcgggcccctcctaatgtcttggacttaagattggggctcgctgggacctggtggtccggttatgggataagaagcctcgtgggagagcagaggacgctggacgatcccggacgccttctgacctctttttaggcaggcgagggttgcgtccacttccacgaagggaggggagcatttaacttttctcagggacagcgacccagtcaggatgtttcacagctttctccttccccagcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaa

SEQ ID NO: 1051 - DNA, 7518 bp, Homo sapiens
  CDS (1)..(7518)
atgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggaggagacaccagcagggcaaaagagagcctggagtatctctcccctgctagagctgtgccggcagtggctgcacggctgtggctcccagtggacctcctcagccagtgacctagtgacccagctctcagggcacagtcccgttttcctgtccatgcttggatggatccagccgagccgtcagccgcagctgcgcgctgctcccccgactcgcaccccctcggcgaagcgctgcattttatgtaattttctgccgggctgctggcttgtgggggatgtggctgggtctcggcagccttcagcgccgcagacgctccggcaacgccagcatacgaggcccccgccccaggagcgcgggtccgggcggcgttcccctctgcgggaggcgcggcgagccaatcctcactttaaaagctttcctgtcctcgaagcgaggggtcttccgtgcggggcaagacgcactggccccagacgaccggtccgtgaaatgacccttccgagcgacccggagcgggcgaccttgcccaacccgcgactcggggcccctgcggtcccgcgtagaggacccagagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttgccttaggagggccactacagtgcatttcttccagggctgccctggctttagtgtttgggccctatgcagttggtgaaggcctatgggaaaaaattgtggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttaggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaggttctgatgtctgttgttcccttctgtactcaatgcttggctctcactttcggattcagtggttttggtatcacagtctagacaaaggacatgtaggcgtaaatatccaaattatggtagaagaaatcgtagctggcgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagatctggcaggaccggagacaactgggaattgccacagtggtttgggatgtggccatggttctctccacacatctggagatgggagctgtggagctcttgggctgccccgcagtgaaactgggtgctggcatagggctgatgggcatagtggctgccctgctgggtgctcatgtgactgtcatagatcgaaaaaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttaggctcaagaaagaattccacattttagcaagtggcaaagatgttggtttgttaacagttattcagattgctggtggggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacagagcactgcatctagctgaaaactggggagtaactgattcttgtcagctttcttggtttgattctgtcctaagtcttggagactcatacgatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggagaaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatga

SEQ ID NO: 1052 - DNA, 2230 bp, Homo sapiens
  CDS (99)..(1976)
ctacgtaccggaccggaatccgggtcgacccacgcgtccgcagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcccgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgctgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaaa

SEQ ID NO: 1053 - DNA, 2161 bp, Homo sapiens
  CDS (99)..(1907)
ctacgtaccggaccggaatccgggtcgacccacgcgtccgcagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcccgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgctgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaaa

SEQ ID NO: 1054 - DNA, 1418 bp, Homo sapiens
  CDS (66)..(1418)
aattcgcctgggagggagagtggcgctacggcgccgccttcctggggagccgcttcgggctccggatgtccgctggggcccgacgcttgggtcccgacgcgcggttcgcactttccaggtttcttccccagggaacagagcttgagcggggggccacccccccgtcctaccggagttctgagaccagcgagtgtgggcctttatctggactctgcttcctccctggggacaccaggtcttggagcaagagaacttggcaggctctccccatggcagtcttattcctcctcctgttcctatgtggaactccccaggctgcagacaacatgcaggccatctatgtggccttgggggaggcagtagagctgccatgtccctcaccatctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 1055 - DNA, 2437 bp, Homo sapiens
  CDS (124)..(1062)
  misc_feature (1)...(2437): n = a,t,c or g
atttggccctcgaggccaagaattcggcacgaggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaagatatgcagcaagtttaatacctgaaggttaacataaatgacaacaggacacagatgcaatgctacagtcaaatgtggttggggatggaagggggcagagggacactggatatcatcacagcaaccagtgagtgagtcctctggtgccctgaggaggttgtgagccacttgactcgtgtcacaaagaatggagtaaactaacaactctgaaagacaagagggtggcagcattgctgagatgagactcaaggcaggggtctgcagctctgtcacagagtgttaatgctcaacgatgcctgggctcaagagcgttctggtcagcattttaacatcagaagaagggcttcttcaggacacactcccttctcttaacatgaggtgaagaaacccatcccattctgaaaccaggtcccataataccttggtcttttgatacacagcagcactacacaccactgtgcccccccagccagcttcactctgtctgctaagcacccactctgcaaacagatctcagagtgaacaaatnccagagaggtgggagagccaccatggngggatgtgaggnacagagtggcttgangagcaaatggtcccatgtcaagacctnctagcatcatgagattgtatactcagaacacctttncccagntngaagcntgcattcaggtagggagttgccaagcgaggatnnccaantacattcacaactgacctgggttgagtatcgtccctgactttttttcatcttcgaagggccagggcttctgtctccaatctgc

SEQ ID NO: 1056 - DNA, 2398 bp, Homo sapiens
  CDS (124)..(1023)
  misc_feature (1)...(2398): n = a,t,c or g
atttggccctcgaggccaagaattcggcacgaggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaagatatgcagcaagtttaatacctgaaggttaacataaatgacaacaggacacagatgcaatgctacagtcaaatgtggttggggatggaagggggcagagggacactggatatcatcacagcaaccagtgagtgagtcctctggtgccctgaggaggttgtgagccacttgactcgtgtcacaaagaatggagtaaactaacaactctgaaagacaagagggtggcagcattgctgagatgagactcaaggcaggggtctgcagctctgtcacagagtgttaatgctcaacgatgcctgggctcaagagcgttctggtcagcattttaacatcagaagaagggcttcttcaggacacactcccttctcttaacatgaggtgaagaaacccatcccattctgaaaccaggtcccataataccttggtcttttgatacacagcagcactacacaccactgtgcccccccagccagcttcactctgtctgctaagcacccactctgcaaacagatctcagagtgaacaaatnccagagaggtgggagagccaccatggngggatgtgaggnacagagtggcttgangagcaaatggtcccatgtcaagacctnctagcatcatgagattgtatactcagaacacctttncccagntngaagcntgcattcaggtagggagttgccaagcgaggatnnccaantacattcacaactgacctgggttgagtatcgtccctgactttttttcatcttcgaagggccagggcttctgtctccaatctgc

SEQ ID NO: 1057 - DNA, 1902 bp, Homo sapiens
  CDS (414)..(1883)
atttggccctcgaggccaagaattcggcacgagggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacttaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaaggggttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaggaaagtctttgaaaaaggtttcaaagtcttc

SEQ ID NO: 1058 - DNA, 1450 bp, Homo sapiens
  CDS (397)..(1176)
  misc_feature (1)...(1450): n = a,t,c or g
atattcggcacaggcagctgaatgtggaggcctttaagagaacttccagctcctgtaaaaacccagaccagaggactactgaccaacatttcaggctgatcctccagacctcgaagttactctccttactctcctgactcttaattacatcacacctgtgtcgacactctctgggaaaagactgaagaaataatcttttcaagaagcagaaagctcctgcatacataggctgatacgccacctactgcaaaaccgagctgacagcgcaggcantgctgccagcgtttccattccatcaccaggctggggctgaataaaggcgtgcttgtgtggtagtgtctctttttaaaaaatctcaaagccaagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagagactactttcttggaaataacagataaccacgatcgttcacaaggattaagaatcttctgtaatgctcctgatttcatatcaaaaataaagtctcgcattgttctggtgtccaaaagcaggctggatggatttccagaggagttttcaatatcgtcaaatatcatccaatttaaatacttcataaagtctgaaaatggcactcgacttgtactaaaggaagacaacacctttgtctgtaccttggaaactcttaagtttgaggctatcatgatggctttaaagtgtggctttagactgctgaccagcctggattgttccaaagggtcaattgttcacagcgatgcacttcattttatcaagtaattacctgtgtcacgaacaaaggcaacaagcatgcagccagcaagcttcggaaaaccacagcatcaaagacatcccaaataacatgcccagctagctctgtactacagagccctgctactaatcaattactgtgagctaacggtatgtaaattctatcgctaaagatgtccttcctctggggtgttcctactgatcagactcttccacctaaaatgaaaacagtaaccttctatatactgtaaataaagactgaaagcttttgctaaaaaaaaaa

SEQ ID NO: 1059 - DNA, 2613 bp, Homo sapiens
  CDS (10)..(2130)
  misc_feature (1)...(2613): n = a,t,c or g
tttcgtgggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtgggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaacccctttttccacaccttgaacagttgggttcaaggggccaccagaagcnttctttatt

SEQ ID NO: 1060 - DNA, 1854 bp, Homo sapiens
  CDS (266)..(961)
  misc_feature (1)...(1854): n = a,t,c or g
aagctggtacgcctgcaggtaccggtccggaattcccgggtcgacgatttcgtgcgcgctcccgaggtcccgcctcgcccgctgagccggcctgtaagcgctgcggagattgggctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaatggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccacacacacacacacacacacacacacacacacacacacacacacggactctccgaatcagggctgggcctctgtgccaggccatcccgtctttggagtgtatcctatttgaggtcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttccttttttttttcgattgttgtgngaaccgccacgccattgctatccctatatccagtctaagccacaggctcggtgcctgcgccattatatcccctag

SEQ ID NO: 1061 - DNA, 3389 bp, Homo sapiens
  CDS (107)..(3343)
cgatgctgtccgcactagtgattttcccgggtcgacgatttcgtcctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggacttaggggttaccctggcttgagtggtgaaaaaggatcaccaggacagaagggaagccgaggcctggatggctatcaagggcctgatggaccccggggacctaagggagaagccggagacccagggccccctggactacctgcctactcccctcacccttccctagcaaaaggtgccagaggtgacccaggattcccaggggcccaaggggagccaggaagccagggtgagccaggagacccgggcctcccaggtccccctggcctctccattggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccccggaccaaaggggtggaaaggtgacgctggggaatgcagatgtacagaaggcgacgaagctatcaaaggtcttccaggactgccaggacccaagggcttcgcaggcatcaacggggagccggggaggaaaggggacaaaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaaacccgctacttgggaggcccatgctgaagaaataggtggaacccatgaagcaggaacttttagttgacgccacacctcccc

SEQ ID NO: 1062 - DNA, 1747 bp, Homo sapiens
  CDS (782)..(1711)
ttttacataaacacacaactttccaaatctttaattacatgttttacagcagtaaaccttgggtggacaaagatactataatctcaaatgacttaccactggcatgcagaaagttaacatatcaggctacttcctccaagaggctttcattgacacccccagcctgagctgtctctcatataattgtttagcatccagtacttcctctcatcataactattatattgtaactaagttacttgtttgtatctccctctgaactgtttcttgactgaaataaatatgtcaactgtttgaatactttcttcacccgtaagtcagtacttcatttttctaaaccaaagcatagaagagctgggaagcaattaaggcgcagtaatctagaggtcatattatgcaagggatatgctgtggctattagcaacagattccattggcttatgaggcactgcctgaagcttccagggaaacatacaggggaaacagtccagaggattcaggatggtctggtacgactctggactagctctatttggaaggtccagtccctacactgaccccagaatgacaccataatgcagccctctctgacatatttgtaactctgcttgccacataatcagtatcctcatctcttagcacatggtaataacattgtctttaacataaaagtgtacctatttgcagtcactacctctatcaccaccaccagcagagcctgagctgaggaaaccacggttctcaatacccagcacacccacttccaactatctgttaaaacatggtggattactatgaagttctaggactgcaaagatatgcttcacctgaggacattaaaaaagcttatcataaagtggcacttaaatggcaccctgataaaaatccagaaaataaagaagaagcagagagaaaattcaaagaagtagctgaggcatacgaggtattatcaaatgatgagaaacgggacatttatgataaatatggcacagaaggattaaacggaggtggaagtcattttgatgatgaatgtgagtacggcttcacattccataagccagatgatgtttttaaagaaatttttcatgaaagggatccattttcttttcacttctttgaagactcgcttgaggacctgttaaatcgtccaggaagctcctatggaaacagaaacagagatgcaggatactttttctccactgccagtgaatatccaatttttgagaaattttcttcatatgatacaggatatacatcacagggttcattggggcatgaaggccttacttctttctcttcactggcttatgataatagtgggatggacaactacatatctgttacaacttcagacaaaatcgttaatggcagaaatattaatacaaagaaaattattgaaagtgatcaagaaagagaagctgaagataatggagagttgacattttttcttgtaaatagtgtggccaatgaagagggctttgcaaaagaatgcagctggagaacacagtcattcaacaactattcaccaaattctcacagctccaaacatgtatctcaatatactttcgtggacaatgatgagggaggtatatcttgggttaccagcaacagagatccccctattttctcagcaggagtcaaagagggtggtaagaggaaaaaaaagaagcgtaaagaggtgcaaaagaagtctaccaaaaggaattgttaaattgactcttcaaatatataacatttgaacacaaaa

SEQ ID NO: 1063 - DNA, 6337 bp, Homo sapiens
  CDS (215)..(6163)
catgcctgcggtaccggtccggaattcccgggtcgacccacgcgtccgcggacgcgtgggggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcacaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaagtttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagagaaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagtagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcaggtagttaatggttacactacaggagactagtaaaataaatgtttgacactgtagttgtgcagttaatggcctgttagtcattgaagatgtgaatagtgggtgagagacatccagttgagttcctgcttcagtcacaggttggaggatgattgctcgagcaggcatctaaggtgacctc

SEQ ID NO: 1064 - DNA, 2367 bp, Homo sapiens
  CDS (445)..(2196)
cgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttacgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacacactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaaaaaaaaaaaa

SEQ ID NO: 1065 - DNA, 4892 bp, Homo sapiens
  CDS (634)..(4275)
atgggaatccccaacttagctcaggtatcctgtaacgcagaagctctgtgaaatgagcagaagtccttaaaagggcctgccggttttcccgcaatcttttacagggtgagcagcgctgtatccactgataacccagctgcttaggaactgagtaaagccggctccaaacttctcagctgttgacaggcttgacttgctgagaacactggttaaatatagcacccgcgagctcagctcctcaacatagccattgctctgacagtgttgtgaagggagcagaagaggagaaacctaatctccgaacccaacaacacctagcaacagtagaaaaaacttttaaacaaaagtctgggtgggagatatacaacaacttccaatttctgctgatcgggatttcagggagaagaagctgctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtgggaatgagatctcgaaaccaaggtggtgaaagtgcatctgatgggcatatctcctgtcccaagccctccatcatcggcaatgctggtgaaaaaagtctctcagaagatgcaaaaaagaagaagaaatcaaataggaaggaggatgatgtcatggcctcaggaactgtcaaacgacacctaaaaacatctggagaatgtgaacgaaaaactaagaaatccctggagttatccaaagaagacctcatccaactactcagtataatggaaggggagttgcaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaaaaaaaaaaaa

SEQ ID NO: 1066 - DNA, 716 bp, Homo sapiens
  CDS (218)..(571)
tggaattcccgggtcgacgatttcgtgaagtgcggcacccagaggcggtcttgtagctgggccagcctggggcttggttctatgtccctgcgggtcggtgcgagggcgaagaggaacccgtgggcccgggggatcccggggggccggaccagtgttccccagttgtgggagcagacgcgtgggcgcatcgcgggcgggcagggcctgaagtgcagctatgtttccagtgttctctggctgtttccaagagctacaagaaaagaataaatctctggagttggtgtcctttgaggaggtagctgtgcacttcacctgggaggagtggcaggacctggatgacgctcagaggaccctgtacagggacgtgatgctggagacctacagcagcctggtatcattggggcattgcattaccaaacctgagatgatcttcaagctagagcaaggagcagagccatggatagtagaagaaaccctaaacctgagactttcaggtggaagcaagaagcaagttttctcaggtatttgccacaagagcctggtggagctccaagaggttcatttggtctgatggattcaggtaccattgaaattctgatagtttcaaaatcttttatctccaggtttgagctctcttgtgaactctggaactgtattcccaactgtcaattggacatccctacgcatgggacctcagatatttcacacatgatgtg

SEQ ID NO: 1067 - DNA, 1676 bp, Homo sapiens
  CDS (238)..(891)
gggcgtgatgatataactctctattcgatgatgaagataccccaccaaacccaaaaaaagagatctctcgaggatccgaattcgcggccgcgtcgacgcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagattttttttttttttggtcatactagagacaggggtctcgctgaactcctggcctccagtgatcctccatcctcggcctcccaaagtgctggaatcacaggggtgagccaccgcgcccagccctctctcttcctcaatgcactctgcttct

SEQ ID NO: 1068 - DNA, 2282 bp, Homo sapiens
  CDS (244)..(2109)
  misc_feature (1)...(2282): n = a,t,c or g
tagcactgccgtaccggtccggaattcccgggtcgacccacgcgtccggtgccctgactacacagtgataagaggtgtcttttttgtttattattaaagaaatgacgtattgggacagaagtctaggagaaactgataaaacattaattgaaatgaaaatgccaagaaaataaaggtctgtgaatagtaggcacgtgagaggatatattaaggctgcattattatgtttgcttttaccagtgaatgaattatgagcttaatttcaaacgtgaaatgcctaacataaaaagtcttggattgacaaatctgaactttctgttaaaaagattaagttctgtacttcctttaattacagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgntgcatccacgtgtggatcagcagcaactcggntttttttgtcaaagacctcggt

SEQ ID NO: 1069 - DNA, 2258 bp, Homo sapiens
  CDS (172)..(1197)
taagcttgcggccgcagtcgcgcggacccgagcgctcctccgcctgtggttaggccggccgagggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatatctgcgcgctgtcttctgagctttcttcctcaccagtgggctgtgcttgttccatttctgtacacccttatttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaaaaaaaaaa

SEQ ID NO: 1070 - DNA, 2635 bp, Homo sapiens
  CDS (259)..(1101)
atttggccctcgaggccaagaattcggcacgagcctaggcggtagaagcagccgcttttctgtcatgcgcattgcggagagtcgttcttccctctttcccgacttcaccactcactgggatcagacccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtattttcttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaaaaaaaaaaa

SEQ ID NO: 1071 - DNA, 4100 bp, Homo sapiens
  CDS (36)..(3548)
  misc_feature (1)...(4100): n = a,t,c or g
ccggaattcccgggtcgacgatttcgtggccagacatggcggaagaggaggcggccaagttggagaagcacttgatgcttctgcggcaggagtatgtcaagctgcaaaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctgtcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagccctcagttgttatacaaaatgatcaaatccaagacagagtacccgctacataaagccatcaaagtggagagagaagacgtggtctccctgtatctgattgaaatggattcccagctccctgggaagctgaatgaagcggaccataacggggacctggcattagacctagccctctcacgacgactggagaatattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcagcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgggacagacaagggctgaccccgtttgcctgtgccatgactttcaagaacaacaagtcagccgaggccattctcaaacgagagtcaggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaactaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgctgtcagactgtgatcgatttcactagatgtctcactcatcagancaggcattcgggctaagtggtaaatgtgattaggaatnagacctcctcccattctgctagcaacatacagggacacttggaaaaccatttcccttccagtcagcttggtgtccatccccagagccaatttcaatggaaangccttttcccccggccccttggggggcctggacctgatngagcgcagagcctctcagcgtaggaagctggctgcttaatcgagctggctttactctagggtaagtggctgtggacttttctgcacagtgttttcataaagataataggatcctcttgcctgaagtctttttttctttttacg

SEQ ID NO: 1072 - DNA, 777 bp, Homo sapiens
  CDS (36)..(653)
ccggaattcccgggtcgacgatttcgtggccagacatggcggaagaggaggcggccaagttggagaagcacttgatgcttctgcggcaggagtatgtcaagctgcaaaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctgtcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggtgagtgaggttgagggtgtcaacaaagcactctagctggcagtcaggagaccgccgctggggacgtagttccatggaaagtgacctctctggcacctggttttctcttgttacacaattgaagaataaatagtttgaaaagatgaaaaaaaaaaaaaaa

SEQ ID NO: 1073 - DNA, 1635 bp, Homo sapiens
  CDS (92)..(1090)
agctggacgaggacaggcgggtgcggccgcccgtaagatgctctgacctttgacccctgccgttcagctctagggcccgtgcaggcacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcagttcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcaccccaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaaaaaaaaaaaa

SEQ ID NO: 1074 - DNA, 1755 bp, Homo sapiens
  CDS (128)..(1210)
ccggaattcccgggtcgacccacgcgtccgctctccgtcctggacacggcggagtgcggacgcgcccgtaagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactcccaggtgaatgccttggaggtcacaccggaccgcagcatgattgctgctgcaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtcccggaacctgcagtgccagcggatcttccaggtgaacgcacccattaactgcgtgtgcctgcacccgaaccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccctggtgcccttctcctgtctacttccgttggccatcggcatcctccaggaaggagaatttgagtccttggccaggcgtggcctcctgttcttggcttgccagggaaactgctatgtctggaatctgacggggggcattggtgacgaggtgacccagctcatccccaagactaagatccctgcccacacgcgctacgccctgcagtgtcgcttcagccccgactccacgctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaaaaaaaaaaaa

SEQ ID NO: 1075 - DNA, 577 bp, Homo sapiens
  CDS (12)..(443)
gaattcccgggatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttctaaatatgctgtataaaataatggcaaaagacagtgttattaaaatgtttccatcttatttgtgattaattgaatatatctatcaacgaaatcgtcgacagcgaagtcgacccgggaattccgaaca

SEQ ID NO: 1076 - DNA, 6481 bp, Homo sapiens
  CDS (335)..(6481)
tcacatttatcttctgtgtccacccagttctgctgaaacccctggcaagatcgtggccctgttgtagcttgtcatgttttgaacagctgtctatggaaagaaagcaaacacaacctagagcaacattgatttgttttagaaagctcttttattttcagttctggctgtgttcaacatcttagcttacgtttttcatgttgtaatgatctgccgtacggacgatcacctctaagttagagagttctgtaatttggcttggattaaagatgcttggttagtgaaagctgctgctttttttatagtcaaaggactggttctgagagccttgttgcagatggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcagatgaagaacacttccaagaaccagactgctcactagaagctcagcccagatatgttagaggtgagaagccttacggacgaaggtccttgcccgagttccaagagtccgtggaggagtttcctgaggtgacggtgattgagcccctggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaacaagtttgtgaagatttggggatcacccctgatggtcacctgaaccggaagaagctggtttccatctgtgagcagtatggtttgcagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaacgacaagtaccattggctttcgggtcttctcctgcctggatgatgggatgggccatgcatctgtggagaggatactcgacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgaacccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaatgaaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcacaggagctgctgaaagagactcttaagagagagaaaacaacttctctggtcctgacccaggagagagagatgctggagaaaacatacaaagaccatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccagcagggggtctcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctctatgcttcagagtggttgccaggtgataggagaggaggaggtggaaggagatggagccctgtccctgcttcagaaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagccgtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttccgagcttgaaaacagtgaagagaccaggactgaatcctgggagctgaaaaatcacattagtctgcttcaggaacagctcatgatgttttgtgcggactgtgatctagcttctgaaaagaaacaggagctactttttgatgtttctgtgctcaaaaagaaactgaaaatccttgagagaatccctgaggcttctcccagatataagctgttgtatgaagatgtgagccgagaaaatgactgccttcaggaagagctggagatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggagctgaatgttctggttttgagacttcaaggcaagattgagaagcttcacgagagcgtggtcaagcggtgtgactgctgcttatgggaaggcagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggtttcatggaacaattcagacacatcacgaacggcctagagtacagaatcaatttatactggaggaaaacactactctcctaggctttcaaaacaaacattttcagcatcaggccacattgccaaatttagaactggaaaaacaaaatttccaggagctgactaggaatttgagggaaaaattccctattttaatttaccaaaaaaattttctttctcccggaaaaaaggaggaagaactgaaggcaatgatgcatgacttgcaaatcccttgcagtgaaatgcagcaaaaggttgaacttctgaaatatgaatctgaaaagcttcaccaggaaaattcttttttgagaaatgaaattactactttaaatgaagaagatagcatttctaacctgaaattagggacattaaatggatctcaggaagaaatgtggcaaaaaacggaatctgtaaaacaagaaaatgctgcagttctgaagatggttgaaaatttaaagaaacagatttcagaattaaaaatcaaaaaccaacaattggatttggaaaatacagaacttagccaaaagaactctccaaaccaggaaaaactgcaagaacttaatcaactgctaacagaaatgctatgccagaaggaaaaagagccaggaaacagtgcattggaggaacgggaacaagagaagtttaatctgaaagaagaaccggaacgttgtaaagtgcagtcctccactttagtgtcttctctggaggcggagctctctgaagttaactacaggacccctattgtgcaacaggaaaacccccttctccaagatgaactggagaaaatgaaacagctgcacagatgtcccgatctctcgaacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagacacagctggtggcttctcaggaaaaggttcagaatttagaagacaccgtgcagaatgtaaacctgcaaatgtcccggatgaaatctgacccacgagtgactcagcaggaaaaggaggctttaaaacaagaagtgatgcctttacataagcaacttcagaattctgtggcaagagctggccccagagagatagatcatccatcagggttccataaccagcagaaaaggctgtcttgggacaagttggattatctgatgaatgaggaacagcagttgttttgcaaagagaatgagaggttccagaccatggtacagaacaccaaagccgaattaacgcattcccgggagaagttccgtcagttggaatccaatcttcttcccaagcaccaaaaatatttaaacccatcaggtaccatgaatcccacagagcaagaaaaattgagcttaaagagagagtgtgatcagtttcagaaagaacaatctcctgctaacaggaaggtcagtcagatgaattcccttgaacaagaattaaaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcgtgccggatggtgcccagggagcagtttttgcggtttaaaccccagttgctgcaggcagaaaggataagccagcacttgcagggggaatttgaaaacaggacctccgaaaccaacacaccacggggaaaccgggaacaattggtaactgtcatggggggaacgaatgatagaagttga

SEQ ID NO: 1077 - DNA, 1236 bp, Homo sapiens
  CDS (111)..(809)
  misc_feature (1)...(1236): n = a,t,c or g
cactatacttacttattgggtaaacgactcactatagggaaagctggtacgcctgcaggtaccggtccggaattcccgggtcgacccacgcgtccgcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatccggacgcgtgggtcgacccgggaattccggaccggtacctgcaggcgtaccagctttccctatagtgagtcgtttnancctcggcgtcacactcgta

SEQ ID NO: 1078 - DNA, 910 bp, Homo sapiens
  CDS (166)..(612)
  misc_feature (1)...(910): n = a,t,c or g
cttccacctgcggtaccggtccggaattcccgggtcgacgatttcgtcatcaacacggcggcggcggcggcgttttcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggagtcccctaaggtgcctatgacatttgatgatgtggctgtgtagttctctgagcaagtgtggggcaagcccagtcgttcagaattggagccgagttcacggagacagagaaccagacagacagaagacccagagccctgggccactccactcctgatgatttagctgccggtcccactctgaccttttggaaagaggctgtgtgaggaaggagtagcctggttgggggtctcactggcctgactctgcaaggaagaggtggctgcacttcccccagcttccagctccagacctttaagccccaggtgcttgtgcctangatttaatgatcaaaaaaaaaaaa

SEQ ID NO: 1079 - DNA, 1832 bp, Homo sapiens
  CDS (384)..(1832)
gggtcatcctaatagaattgttttgcgaattgaaagagataatacaaatgaaagccttaaagttgtccctgtcacttggtgagtggtctcttgttgcctgatattttaaaacgtttgatatcatttcaaagctatagaaaaattgcaaaaacagtataagaaattctcatataccctttacccaaatttgccaagtgtttacatttttcctgtttgctttgttgatgaccatcaaccaaataccaccaggaacatacctgtaaccagagacagctgattggtagctttctgcagcaaggaagctcacataccacggcacaattctgctttccctggaactgtgtcattcatgactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagagaagggaattcaggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggaatatctataatgcacacaggacagaaaccttccaattgtgggaagagtaaacaatccttcagtgatatgtccatctttgatcttcctcagcaaatacgctcagcagagaagtctcattcctgtgatgagtgtggaaaaagcttctgttacatctcagcacttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaa

SEQ ID NO: 1080 - DNA, 1988 bp, Homo sapiens
  CDS (135)..(1988)
accctttattctgtgatattttgagctgttctgcgtctcgcaggcccttctgaatttcctggacctactctcggaaccctcaacgagctagcgatagatttagaggaaaggaagcaccgtcggaaagcaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccatcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaacgtgggcaatgtgggaaaggcttccatagtagatcagcacttaatgttcattgcaaattgcacacaggagagaaaccttataattgtgaggaatgtgggaaagccttcattcatgattcacagctccaggaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagtacacaacttcattcccatcagacatgccatactggagaaaagctatacaaatgtgagcagtgtgagaaggggtacaacagtaaatttaatcttgacatgcaccagagggtccacaggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataa

SEQ ID NO: 1081 - DNA, 1677 bp, Homo sapiens
  CDS (252)..(1106)
  misc_feature (1)...(1677): n = a,t,c or g
atatctgaaatttcagnccgcgtcgnccgcggccgcgtcgaccttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactgggg

SEQ ID NO: 1082 - DNA, 1809 bp, Homo sapiens
  CDS (360)..(1487)
cggccgcagcacccggaagctgagggggcttaaagtctttcgcttcctttccccgcctcttagtcccgcagattgctagtggatatggccaataggagggctgactggtacttcctgttatttgattggcttaaaattttgcaaccgcccggacaaacttgccgaggattggctgagccttcagttttgaaaatcatagttttcgcccgcgctgcgccgcctggttgctcctcccgtgcggtgagtcccgaaggcccggagccaagtgggtctgggcaagcggggccttacctagggataccaccggacttggatcggagcagccttcaggggacgtggcgcagtcgaacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtgagtctgggggcttggcagtggcgggtggtccttggtgccaggctcagatggaggctttctgagggatcatctagcaaggagctgtccagagagctttctgcagtgaggtagatgttacacatctgtgctgtcctgggatggtggccgctagctggcctcatctggcgattgtgtcctcaaaatgtggctagtgtgattgaggaactgaattttaaattgtattgcattctacttcttttagatttaaatagttacatgtagctagtggcttccacgttggatggtgcaggtctgacccaacctacttgctttacaagtgaggaaactgagcttcgggaaggctcagaacaacgacagcggccgctctagaggatccaagcttac

SEQ ID NO: 1083 - DNA, 8309 bp, Homo sapiens
  CDS (162)..(2843)
tcccgggccgacgatttcgtgcgagcggcagcagctccggactcgagagcccgcgcccatgccagtgcccatgcggggccgccgccagtgacgccggagaggtgttccccccacactggggctcccactactgcgaggagtgacccacgaaggccacagagatggccggtgcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactgggcgcacacctcacctgaggacatcaactacgcgtcgcaaaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcacccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagaagcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccagggccatctcagccgatgaagaggcccctgattatggctctggcgtccgccagtcgggaactgctaaaatctcctttgatgaccagcattttgaaaagttccagtccgagtcttgccccgtggtggggatgttccgcttgtgtaacctcccaggaagagcttcgcatcgtggagggccagtgtttagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccctccacttggcttctaccacgtccagaacatcgcaggggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggccgcagcctcttcagctgcggcgagaaatggagtgatgtcacggtagcttctgggaagaaatgctgccattatcagggttcttgcaaagactttcctctctttgttcccagggcagagagtttctgtgagtcccactgagaaaatcccatggggtgggggtatcctggtcggtcggcaatggagggcggctggcttggtggttattgacttcaaggagctctttgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcgggggtggccaccgccaccctcatcccctggcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaatccagtgtggcctgtgctccccatgggtgacctctggaggcagaggaccaatgatgcaacaaggagaggatgcacaacagcttcttgcataagcacctgctccggcatccatcgctgcctggaggcaggaaggaaaggcagggcacgacacgctggtctgagatgaaggggagccccacgggccccatgcaggctagaggaggcacaggccctgccacggccaactaacgtcaaccagcctgaggctgtggcctccaaagggtctgggcgcaccccccaggtcgcaggtgtctgaggccagccaacctgcatagcactcgccgcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcaaagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggggcttgggagacagccaggcccagggtggctgctgcttcctgctaagtgggggaggtgagacagatctggaaagccgtctccctcagatggcttcatttaatgctttatactgccgagtctgggggcttgttttggtttgggggcagccatcctccaccagaaagggggagctcctttcgctgcggatccagatagatggggatgccgggctccaggccgaccagcacttgggatctgatgggacacggccagtgcctaggggtgccaagtccaaggcctcccactgggagt

SEQ ID NO: 1084 - DNA, 2920 bp, Homo sapiens
  CDS (87)..(1922)
ccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtagggcattactgggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaa

SEQ ID NO: 1085 - DNA, 2817 bp, Homo sapiens
  CDS (109)..(2817)
gttcgctcgtatcctctagagcggccgcggctgggggcggggaggggggcgcaggaccctttgtgggtgtcccggagccagagggccaattcctgtccccccagcagcatggcatcgtgtgctgaaccctctgagccctctgccccactgcccgccggggtcccaccgctcgaggacttcgaggtactggatggggttgaggatgcacagggtgaggaggaagaggaggaggaagaggaggaagaggatgacctgagtgagctgccaccgttggaggagactggggagggccggcggggcgcggaggaggaggatctgggggaagaggaggaggagggccaggcgcacctggaggactggagggggcagctcagtgagcttctgaacgactttgaggagaggcttgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagagacccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaa

SEQ ID NO: 1086 - DNA, 437 bp, Homo sapiens
  CDS (50)..(436)
tttcgtgcgcaggcggcggaggcggctggggggtccggaagtcaacaccatgttatgtttgcacaagagccgaattgcagatttgcaggatgtcctgaaggagccctcaattgcattggaaaagctgcgggaactcagctttagtggcatcccctgtgagggcggactgcggtgcctctgctggaagattctcttgaactaccttcccttggagagggcctcatggacctccatcctggccaagcagagggagctgtatgcccagttcctgagggaaatgatcatccagcctggcattgccaaggccaacatgggtgtgtccagggaggatgtgacttttgaggaccattcactcaaccccaaccctgacagccggtggaacacgtacttcaaggacaacgaggtgctgctgcagatcgacaaagatgtccggtagg

SEQ ID NO: 1087 - DNA, 2576 bp, Homo sapiens
  CDS (1716)..(1856)
ccggtccggaattcccgggtcgacgatttcgtggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaaggtaagtggttatcttacttttatgtgcttcctggatttgtgtgtgaattacataaactgggtatttcttgtttaatcccccttttctctgtctcccctttggcagcctggatggtggagttcggctgcatctggagtgcactaataccgctcctggttggcggataggtatttccatatatgtgatgcacccgtggtggttccctctttttttcttttttttttttttttttaagtatttttagtttctggggagaatcaaaatgtacttataatagaatcagtatgtagtagcttaagaggaccaaggtttcagtaaaactcagcctactgtggttgatcttaacatggttatcaggagtttccttgaatttaatctagcccttatctaaacttcagtttactttaatagaaaagaaaaatggtctggatgtcacttgggcccaaaatcttttggtacattttagtgccctttcttcacccattcagaagtacttctgcagctggaatggtccttcagagaacactcagttcttctagaaaggagacacttaaaatataattgcctctccctcccatccctaactcatacagccagaaagtcaggttgaaggattgtggaggactctgctcttgaacttttctgcacggacagcaggaccaccagtgcatgtgtgactcagtgtggcatttgtctgcagggcatatgtacaccaacccatccctgcctctttttaccagtgcatggatcatttctctctcttctgatctcttccagagtacccagtactatgacatgcgctggtcatgtgagcacctcattatggtgtggatcaatgcttttgtcatgctctaccacgcaactgatgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatg

SEQ ID NO: 1088 - DNA, 826 bp, Homo sapiens
  CDS (529)..(795)
taagcttgcggccgccaactttttttttttttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtaaggataattttgctctagaagttaagatctgccctcgtgtatttttgtattttctctgttgtctttcttgggagcccttccattatttgactgagactgaagccttgttgactcacaaataaaaagcttcataatgctgaaaaaaaaaaaaaa

SEQ ID NO: 1089 - DNA, 765 bp, Homo sapiens
  CDS (65)..(595)
gctccgcccttcccgagtcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcacggtgaaataagcttgccaggaggctggcagtacagagtgcagcagcgagcaaatcctggcaagtgacccagctcttctcccccaaacccacgcgtgttctgaaagtgcccatgagcggcgatgcactctcactgcaaatgccgctctcacgtatgcgccctgttatgtgcctgcgttctg

SEQ ID NO: 1090 - DNA, 2030 bp, Homo sapiens
  CDS (197)..(1672)
atttggccctcgaggcatagaattcggcacgagggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctaaaaaaaaaaaaa

SEQ ID NO: 1091 - DNA, 1423 bp, Homo sapiens
  CDS (630)..(950)
cgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggagcaatacaagtggtatgtgttttatagcctacaattgcaataatcattctctcacatacatatagaacttagccctttctcctgctactgctgctgcaacaactttgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagctgtgcgagtaaaaattatcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgctgaaaccacttcattggacatgttgcaatagccaaacccccagttagattagggcttacacattttctcagatatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaacg

SEQ ID NO: 1092 - DNA, 1243 bp, Homo sapiens
  CDS (319)..(891)
gcggtaccggtccggaattcccgggtcgacgatttcgtgttttctgtattgtaatatgtagagcacattccagaactgctcagtttcgagttacctaatggatcttcactgtgtgccaattagtcgatttctgtgaaaacgccccggtttctgccaaagggcaggagtcgctgctcttgtgccgggtgctgctggttgtgtagggcgctgttgcttttttaaggacgctctgcactgaattaggcttcctcgtgggtcatgatcagttaagtcctgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacactaaaaatccatccatctcagtcaaagtcgagcggccgcgaatttagtagtagtagcggccgctctagaggatccaagcttacgtacgcgtgcatgcgacgtcatagctcttctatagtgtcacctaaattcaagtt

SEQ ID NO: 1093 - DNA, 819 bp, Homo sapiens
  CDS (204)..(653)
aggcagagccaagtgcgtcctggaggcttcccccgttgcgaaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttacttcggctatctacatgcagatgaatgagaccaggcccttatttcacaccatatactaaaatcatctcaaaatacattataatgcagacataagatgcgaaactgtaaaactactggaagaaaacacaggggaaaatctccatgatactggtctgggcaatgttttcctggatatgaccccaaatacacagtcctccccacgtaaattaacagatgccattatag

SEQ ID NO: 1094 - DNA, 2350 bp, Homo sapiens
  CDS (202)..(1929)
atttggccctcgaggccaagaattcggcacgagctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtggcaggtgctctggctgaggctggtgtggggctggaggagatcgcaaagcaggtgaacgtggtcaccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaaaaaaaaaaaa

SEQ ID NO: 1095 - DNA, 1200 bp, Homo sapiens
  CDS (118)..(708)
atttggccctcgaggcaagacttcggcacgaggctgaagtgggagcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcctcccctcaactctggagccccatccccaccctccttggggggctcagcttggctcagatctgatgcttcaagaggctgtaacctcagagggcaccaaggagggtggcagagcctgtttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgctaataggtggaaaaaaaaaaaa

SEQ ID NO: 1096 - DNA, 1937 bp, Homo sapiens
  CDS (71)..(1495)
gtccggaccggacttcccgggtcgacgatttcgtggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggggggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaattctgctcaattgaaaaaaaaaaaa

SEQ ID NO: 1097 - DNA, 3144 bp, Homo sapiens
  CDS (129)..(2027)
gtctctcttaggtaccggtccggaattcccgggtcgacgatttcgtgggcgcggcgctgctctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctggttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaagtgcaaaaaaaaaaaa

SEQ ID NO: 1098 - DNA, 2307 bp, Homo sapiens
  CDS (177)..(1775)
cggcccggtattctcgggtcgaccatttgtgccgccgccgctgccgcgcggtggcccgtgcgcctcggttccttttgcaatttccgtcgggccccagccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgcttttttttttttttttttcctcttcaacttagttgacatacgtgccttaaaaaggaaaactagtgttgctattgtgcatttacgggaaaaaaggattggttgtttaggggcacactgttatatggggtattaaaaatgtttaaggcaggggtttattaaaaaaggttaagtttttttttaccactgtttagggaccttaattttgaaatactgggcttttcaaccttttttccaaattaaaccaaaaagggtaccaggatattgaaaggataagaa

SEQ ID NO: 1099 - DNA, 1471 bp, Homo sapiens
  CDS (40)..(1284)
atttggccctcgaggccaagaattcggcacgagggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttttaaaaaaaaaaaa

SEQ ID NO: 1100 - DNA, 1382 bp, Homo sapiens
  CDS (117)..(1229)
gggggaattgaagcctgtgggaattgaacgccttcgggaccggaccggaattcccgggtcgacccacgcgtccgaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcaaaaaaaaa

SEQ ID NO: 1101 - DNA, 1712 bp, Homo sapiens
  CDS (551)..(1672)
caagctcgtaaacgactcactatagggaaagctggtacgcctgcaggtaccggtccggaattcccgggtcgacgatttcgtgccgggcccccggcgccgcgtcctcctcatcctccaggcgacaagctgcggctcagccccactgaccttggctcctgcccgccctgcggcccctgccccatcccgaagccggcagccagaggcaggcgccagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcaggggtggattgccctagcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcattcctcttgcccttatgaatctctctcgggccgagtttgaccatttcgcaggcacacgcttgagccttgaggccctgaggcagcaggagacacgagatgtccccagagaataggggccacctgtgggagagtgaggtgctgagccacgccact

SEQ ID NO: 1102 - DNA, 813 bp, Homo sapiens
  CDS (497)..(721)
ctgcacgtaccggtccggaattcccgggtcgacgatttcgtaatatctccagaaatagggataacgctactgatagttagtcattcgtatattagcggtttttattgcaactttgaaacgttaaaaatggtgggtattcgatttttctctcgtttttgtcaattcgattgtccacagttatggtcacgcccgtcaccaacggcttaccggatcgtttcacagtaagccctacgatgaaatgtgacaaaaattgactttattcagcaaaaatgaaaatcagcccgctgaatatgtaacattaattaacccgaacaatacgggcaaaaaacattcatgataaaaatatttattggtcattatattaacgtattttatagcactgccgatatcacgctcaaaaaacaaccactgctatttttagcaaagcttatggtatactccgccgccttaacatttttcaccgcaaattttcattgcaacatgacgaggaaaataaatgagtacgcctgatttttctactgccgagaataatcaagaactggcaaatgaagtctcctgcctgaaagcgatgctgacgctgatgctgcaggcgatgggacaagctgacgcgggccgcgtgatgttaaagatggaaaaacagcttgcgctgatcgaagacgaaacccaggctgcagtattttccaaaacggttaagcaaattaaacaagcctaccgtcagtaatataaaaccggctgatagcgtgcctttcagccggtttttgcatctggcacgcaggacagaaaagagatcaaattaagccagtagcggccgct

SEQ ID NO: 1103 - DNA, 1211 bp, Homo sapiens
  CDS (541)..(1080)
gtaaaggcggtagtggtgccccccaagaagggtgttggtcgcccgaacggttctgtcattcgtttggatggtaatgcgtgtgttcttgtgaccaccaccagcgagcagcctatcggtacgcgtatttttgggccggtaactcgtgagcttcgtagtgagaagttcatgaaaattatctctctggcaccagaagtactctaaggagcgaatcatggcagcgaaaatccgtcgtcatgacgaagttatcgtgttaaccggtaaagataaaggtaaacgcggtaaagttaagaatgtcctgtcttccggcaaggtcattgttgaaggtatcaacctggttaagaaacatcagaagccggttccggccctgaaccaaccgggtggcatcgttgaaaaagaagccgctattcaggtttccaacgtagcaattttcaatgcggcaaccggcaaggctgaccgtgtaggctttagattcgaagacggtaaaaaagtccgtttcttcaagtctaacagcgaaactatcaagtaatttggagtagtacgatggcgaaactgcatgattactacaaagacgaagtagttaaaaaactcatgactgagtttaactacaattctgtcatgcaagtccctcgggtcgagaagatcaccctgaacatgggtgttggtgaagcgatcgctgacaaaaaactgctggataacgcagcagcagacctggcagcaatctccggtcaaaaaccgctgatcaccaaagcacgcaaatctgttgcaggcttcaaaatccgtcagggctatccgatcggctgtaaagtaactctgcgtggcgaacgcatgtgggagttctttgagcgcctgatcactattgctgtacctcgtatccgtgacttccgtggcctgtccgctaagtctttcgacggtcgtggtaactacagcatgggtgtccgtgagcagatcatcttcccagaaatcgactacgataaagtcgaccgcgttcgtggtttggatattaccattaccactactgcgaaatctgacgaagaaggccgcgctctgctggctgcctttgacttcccgttccgcaagtaaggtagggttactaaatggctaagcaatcaatgaaagcacgcgaagtaaaacgcgtagctttagctgataaatacttcgcgaaacgcgctgaactgaaagcgatcatctatgatgtgaacgcttccgacgaa

SEQ ID NO: 1104 - DNA, 1327 bp, Homo sapiens
  CDS (251)..(1300)
accggtccggaattcccgggtcgacgatttcgttgaactgcaggtctctccccagtggaaagccccagagatgagccagatctgcctcagctgtggccatccgtcagcgtaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatggacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttcgggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtaaaaaaaaaaaa

SEQ ID NO: 1105 - protein, 948 aa, Homo sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPPQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITVTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQRGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSEQMLRSELLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

What is claimed is:

1. The isolated polypeptide of SEQ ID NO: 1105.
2. A composition comprising the polypeptide of claim 1 and a carrier.

* * * * *